United States Patent
Degrave et al.

(10) Patent No.: US 11,439,152 B2
(45) Date of Patent: Sep. 13, 2022

(54) CONTROL OF HEMIPTERAN PESTS USING RNA MOLECULES

(71) Applicant: SYNGENTA PARTICIPATIONS AG, Basel (CH)

(72) Inventors: Lies Degrave, Gent-Zwijnaarde (BE); Myriam Beghyn, Gent-Zwijnaarde (BE); Yann Naudet, Gent-Zwijnaarde (BE); Lien De Schrijver, Gent-Zwijnaarde (BE); Kevin V Donohue, Durham, NC (US)

(73) Assignee: Syngenta Participations AG, Basel (CH)

( * ) Notice: Subject to any disclaimer, the term of this patent is extended or adjusted under 35 U.S.C. 154(b) by 0 days.

(21) Appl. No.: 16/757,106

(22) PCT Filed: Oct. 16, 2018

(86) PCT No.: PCT/EP2018/078240
§ 371 (c)(1),
(2) Date: Apr. 17, 2020

(87) PCT Pub. No.: WO2019/076891
PCT Pub. Date: Apr. 25, 2019

(65) Prior Publication Data
US 2020/0236949 A1    Jul. 30, 2020

Related U.S. Application Data

(60) Provisional application No. 62/573,785, filed on Oct. 18, 2017.

(51) Int. Cl.
*A01N 63/60*    (2020.01)
*C12N 15/113*    (2010.01)
*C12N 15/82*    (2006.01)

(52) U.S. Cl.
CPC ............ *A01N 63/60* (2020.01); *C12N 15/113* (2013.01); *C12N 15/8218* (2013.01); *C12N 15/8286* (2013.01); *C12N 2310/14* (2013.01)

(58) Field of Classification Search
CPC ...................................................... A01N 63/60
USPC ...................................................... 800/302
See application file for complete search history.

(56) References Cited

U.S. PATENT DOCUMENTS

2013/0029118 A1    10/2013  Bogaert et al.
2015/0259701 A1*    9/2015  Avisar ................ C12N 15/1137
                                                        47/58.1 R

FOREIGN PATENT DOCUMENTS

| WO | 2007083193 A2 | 7/2007 | |
|----|----|----|----|
| WO | 2011060920 A2 | 5/2011 | |
| WO | 2012055982 A2 | 5/2012 | |
| WO | 2014159829 A1 | 10/2014 | |
| WO | 2016060913 A1 | 4/2016 | |
| WO | 201716171 | 6/2016 | |
| WO | 2016100490 A1 | 6/2016 | |
| WO | 2016105696 A1 | 6/2016 | |
| WO | WO-2017106171 A1 * | 6/2017 | ........... C12N 15/113 |

OTHER PUBLICATIONS

Thomas et al. The Plant Journal 25(4):417-425 (Year: 2001).*
Partial Search Report for Internaional Patent Application No. PCT/EP2018/078240 dated Dec. 20, 2018.
"Predicted: Halyomorpha Halys 60S Ribosomal Protein L36 (LOC106677610), MRNA", XP002786691, Database Accession No. XM 014415639.
Yu Fang et al: "Proteome Analysis Unreavels Mechanism Underling the Embryogenesis of the Honeybee Drone and Its Divergence With the Worker (Apis Mellifera Lingustica)", Journal of Proteome Research, vol. 14, 9, Aug. 14, 2015; pp. 4059-4071.
International Search Report and Written Opinion for International Application No. PCT/EP2018/078240 dated Jul. 16, 2019.
Fishilevich, Elane et al., Use of chromatin remodeling ATPases as RNAi targets for parental control of western corn rootworm (*Diabrotica virgifera virgifera*) and Neotropical brown stink bug (*Euschistus heros*), Insects Biochemistry and Molecular Biology, vol. 71, Feb. 10, 2016, pp. 58-71.
Taning, Clauvis NJI et al., Oral RNAi to control *Drosphila suzukii*: laboratory testing against larval and adult stages, Journal of Pest Science, vol. 89, No. 3, Feb. 15, 2016, pp. 803-814.
Communication Pursuant to Rule 164(2)(b) and Article 94(3) EPC and Search Results for Application No. EP 18788755.9.

* cited by examiner

*Primary Examiner* — Li Zheng
(74) *Attorney, Agent, or Firm* — BakerHostetler; Toni-Junell Herbert

(57) ABSTRACT

Disclosed are double stranded RNA molecules that are toxic to hemipteran insects. In particular, interfering RNA molecules capable of interfering with pest target genes and that are toxic to the target pest are provided. Further, methods of making and using the interfering RNA, for example in transgenic plants or as the active ingredient in a composition, to confer protection from insect damage are disclosed.

14 Claims, No Drawings

Specification includes a Sequence Listing.

CONTROL OF HEMIPTERAN PESTS USING RNA MOLECULES

CROSS-REFERENCE TO RELATED APPLICATIONS

This application is a 371 National Stage application of International Application No. PCT/EP2018/078240 filed Oct. 16, 2018 which claims priority to U.S. 62/573,785, filed Oct. 18, 2017, the entire contents of which applications are hereby incorporated by reference.

FIELD OF THE INVENTION

The invention relates generally to the control of pests that cause damage to crop plants by their feeding activities, and more particularly to the control of hemipteran pests by compositions comprising interfering RNA molecules. The invention further relates to the compositions and to methods of using such compositions comprising the interfering RNA molecules.

BACKGROUND

The stink bug complex (family Pentatomidae) represents major agricultural pests of cotton and soybeans in the Americas. Stink bugs are represented by a pest complex that contains more than a dozen species with composition, prevalence, and distribution varying with geography (Koch and Pahs, 2014; Pilkay et al., 2015; Temple et al., 2013). In South America, the stink bug complex is the most destructive pest of soybean crops. In Brazil, a global leader in soybean production, the Neotropical brown stink bug, *Euschistus heros*, is the main target for insecticide applications in soybeans (Sosa-Gomez et al., 2009).

Several native Cry proteins from *Bacillus thuringiensis*, or engineered Cry proteins, have been expressed in transgenic crop plants and exploited commercially to control certain lepidopteran and coleopteran insect pests. For example, starting in 2003, transgenic corn hybrids that control corn rootworm by expressing a Cry3Bb1, Cry34Ab1/Cry35Ab1 or modified Cry3A (mCry3A) or Cry3Ab (eCry3.1Ab) protein have been available commercially in the US. However, these Bt insecticidal proteins only protect plants from a relatively narrow range of pests. Moreover, these modes of insecticidal activity provided varying levels of specificity and, in some cases, caused significant environmental consequences.

Previous control of stink bugs relied on broad spectrum insecticides. With the adoption of transgenic controls for major lepidopteran pests in several crops, these insecticides are no longer used and stink bugs have become a major secondary pest. No successful use of transgenic control of stink bugs using Bt insecticidal proteins has been described or adopted. This may be due in part to the extra oral digestion employed by stink bugs where digestive enzymes are injected into the host plant prior to feeding. This makes it difficult to find proteins that survive long enough to manifest activity against these insects. Thus, there is an immediate need for alternative methods to control pests.

RNAi offers a potential transgenic approach to control this insect pest complex because it relies on double stranded RNAs, rather than proteins. Successes in inducing RNAi in aphids (Hemiptera: Aphididae) by introducing dsRNA in artificial diet and/or via in planta expression of dsRNA hairpins to control green peach aphid, Myzus persicae (Coleman et al., 2015; Pitino et al., 2011), the pea aphid *Acyrthosiphon pisum* (Mao et al., 2013; Mao and Zeng, 2012), and the grain aphid, *Sitobion avenae* (Wang et al., 2015), bolster the potential for achieving RNAi in stink bugs. However, oral RNAi delivery to other hemipteran pests, such as *E. heros*, remained an obstacle that is difficult to overcome. Recent advances in addressing this problem suggest that successful oral delivery of RNAi to stink bugs, including *E. heros*, is possible.

RNA interference (RNAi) occurs when an organism recognizes double-stranded RNA (dsRNA) molecules and hydrolyzes them. The resulting hydrolysis products are small RNA fragments of about 19-24 nucleotides in length, called small interfering RNAs (siRNAs). The siRNAs then diffuse or are carried throughout the organism, including across cellular membranes, where they hybridize to mRNAs (or other RNAs) and cause hydrolysis of the RNA. Interfering RNAs are recognized by the RNA interference silencing complex (RISC) into which an effector strand (or "guide strand") of the RNA is loaded. This guide strand acts as a template for the recognition and destruction of the duplex sequences. This process is repeated each time the siRNA hybridizes to its complementary-RNA target, effectively preventing those mRNAs from being translated, and thus "silencing" the expression of specific genes from which the mRNAs were transcribed. Most plant microRNAs (miRNAs) show extensive base pairing to, and guide cleavage of, their target mRNAs (Jones-Rhoades et al. (2006) *Annu. Rev. Plant Biol.* 57, 19-53; Llave et al. (2002) *Proc. Natl. Acad. Sci. USA* 97, 13401-13406). In other instances, interfering RNAs may bind to target RNA molecules having imperfect complementarity, causing translational repression without mRNA degradation. The majority of the animal miRNAs studied so far appear to function in this manner.

RNAi has been found to be useful for insect control of certain insect pests. RNAi strategies typically employ a synthesized, non-naturally occurring "interfering RNA", or "interfering RNA molecule" which typically comprises at least a RNA fragment against a target gene, a spacer sequence, and a second RNA fragment which is complementary to the first, so that a double-stranded RNA structure can be formed. This non-naturally double-stranded RNA takes advantage of the native RNAi pathways in the insect to trigger down-regulation of target genes that may lead to the cessation of feeding and/or growth and may result in the death of the insect pest.

Although it is known in the literature that RNAi strategies focused on target genes can lead to an insecticidal effect in insect species, it is also known that not every target sequence is successful, and that an insecticidal effect cannot be predicted. For example, the overwhelming majority of sequences complementary to corn rootworm DNAs are not lethal in species of corn rootworm when used as dsRNA or siRNA. Baum et al. ((2007) Nature Biotechnology 25:1322-1326), describe the effects of inhibiting several Western Corn Rootworm (WCR) gene targets by RNAi. These authors reported that the 8 of 26 target genes they tested were not able to provide experimentally significant coleopteran pest mortality, even at a very high iRNA (e.g., dsRNA) concentration of more than 520 ng/cm$^2$. Additionally, a target gene against which a dsRNA molecule is known to give a strong RNAi effect in one insect species may not be a good target for a different insect species. Bachman et al ((2013) Transgenic Research 22:1207-1222) teach that a highly efficacious target in WCR had little to no activity in a second insect species, namely *Leptinotarsa decemlineata* (also referred to as Colorado Potato Beetle, or CPB). This is despite the fact that CPB and WCR are both coleopterans and both species of the Chrysomelidae family.

There is an ongoing need for compositions containing insecticidal active ingredients, particularly against stink bugs, and for methods of using such compositions, for instance for use in crop protection or insect-mediated disease control. Ideally such compositions have a high toxicity and are effective when ingested orally by the target pest. Thus any invention which provided compositions in which any of these properties is enhanced would represent a step forward in the art.

SUMMARY

The needs outlined above are met by the invention which, in various embodiments, provides new methods of controlling economically important insect pests. The invention in part comprises a method of inhibiting expression of one or more target genes in hemipteran insect pests. Specifically, the invention comprises methods of modulating expression of one or more target genes in stink bug species, such as *Euschistus* spp. (for example *E. servus* (Brown Stink Bug), and *E. heros* (Neotropical Brown Stink Bug)), *Nezara* spp. (for example *N. antennata, N. hilare*, and *N. viridula* (Southern Green Stink Bug)), *Piezodorus* spp. (for example *P. guildinii* (Red-banded Stink Bug)), *Halyomorpha* spp. (for example *H. halys* (Brown Marmorated Stink Bug)), *Chinavia* spp. (for example *C. marginatum, C. hilare* (Green Stink Bug)), *Dichelops* spp. (for example *D. melacanthus, Dichelops furcatus*), *Edessa* spp. (for example *E. meditabunda*), *Thyanta* spp. (for example *T. perditor* (Neotropical Red Shouldered Stink Bug)), *Horcias* spp. (for example *H. nobilellus* (Cotton Bug)), *Taedia* spp. for example *T. stigmosa*), *Dysdercus* spp. (for example *D. peruvianus*), *Neomegalotomus* spp. (for example *N. parvus*), *Leptoglossus* spp. (for example *L. zonatus*), *Niesthrea* spp. (for example *N. sidae*), *Eurygaster* spp. (for example *E. intergriceps, E. maura*), *Oebalus* spp. (for example *O. mexicana, O. poecilus*, and *O. pugnase*), *Scotinophara* spp. (for example *S. lurida, S. coarctata*), and related species, that causes cessation of feeding, growth, development and reproduction, and eventually results in the death of the insect. The method comprises introduction of an interfering RNA molecule comprising a double-stranded RNA (dsRNA) or its modified forms such as small interfering RNA (siRNA) sequences, into cells or into the extracellular environment, such as the midgut, within a pest insect body wherein the dsRNA or siRNA enters the cells and inhibits expression of at least one or more target genes and wherein inhibition of the one or more target genes exerts a deleterious effect upon the pest insect. The interfering RNA molecule is non-naturally occurring. It is specifically contemplated that the methods and compositions of the invention will be useful in limiting or eliminating pest insect infestation in or on any plant by providing one or more compositions comprising interfering RNA molecules comprising dsRNA or siRNA molecules in the diet of the pest. The invention also provides interfering RNA molecules that when delivered to an insect pest inhibits, through a toxic effect, the ability of the insect pest to survive, grow, feed and/or reproduce, or to limit pest related damage or loss to crop plants. Such delivery may be through production of the interfering RNA in a transgenic plant, for example a soybean plant, or by topically applying a composition comprising the interfering RNA to a plant or plant seed, such as a soybean plant or soybean seed. Delivery may further be through contacting the insect with the interfering RNA, such as when the insect feeds on plant material comprising the interfering RNA, either because the plant material is expressing the interfering RNA through a transgenic approach, or because the plant material is coated with a composition comprising the interfering RNA. The interfering RNA may also be provided in an artificial insect diet which the insect then contacts by feeding. The interfering RNA molecule comprises a nucleotide sequence that is complementary to a nucleotide sequence of a mRNA transcribable from a target gene of the pest insect, or is complementary to a fragment of a nucleotide sequence of a mRNA transcribable from a target gene of the pest insect, and therefore inhibits expression of the target gene, which results in cessation of feeding, growth, development, and/or reproduction and/or eventually results in death of the pest insect. The invention is further drawn to nucleic acid constructs, nucleic acid molecules and recombinant vectors that comprise or encode at least a fragment of one strand of an interfering RNA molecule of the invention. The invention also provides chimeric nucleic acid molecules comprising an antisense strand of a dsRNA of the interfering RNA operably associated with a plant microRNA precursor molecule. The invention also provides artificial plant microRNA precursors comprising an antisense strand of a dsRNA of an interfering RNA of the invention.

The invention further provides an interfering ribonucleic acid (RNA) molecule wherein the RNA comprises at least one dsRNA wherein the dsRNA is a region of double-stranded RNA comprising annealed complementary strands, one strand of which comprises a sequence of at least 19 contiguous nucleotides which is at least partially complementary to a target nucleotide sequence within a hemipteran or stink bug target gene, and (i) is at least 65% identical to at least a 19 contiguous nucleotide fragment of SEQ ID NO: 217-324, SEQ ID NO: 432-484, SEQ ID NO: 592-645, SEQ ID NO: 806-858, or the complement thereof; or (ii) comprises at least a 19 contiguous nucleotide fragment of SEQ ID NO: 217-324, SEQ ID NO: 432-484, SEQ ID NO: 592-645, SEQ ID NO: 806-858, or the complement thereof; or (iii) comprises at least a 19 contiguous nucleotide fragment of a nucleotide sequence encoding an amino acid sequence encoded by SEQ ID NO: 217-324, SEQ ID NO: 432-484, SEQ ID NO: 592-645, SEQ ID NO: 806-858, or the complement thereof, wherein the interfering RNA molecule has insecticidal activity on a hemipteran plant pest. In some embodiments, the interfering molecule may comprise at least two dsRNAs, wherein each dsRNA comprises a sequence of nucleotides which is at least partially complementary to a target nucleotide sequence within the target gene. In further embodiments, each of the dsRNAs may comprise a different sequence of nucleotides which is complementary to a different target nucleotide sequence within the target gene.

The invention further provides compositions comprising one or more interfering RNA molecules comprising two or more of dsRNA molecules, wherein the two or more RNA molecules each comprise a different antisense strand, or comprising two or more nucleic acid constructs or nucleic acid molecules or artificial plant microRNA precursors of the invention.

The invention further provides insecticidal compositions for inhibiting the expression of a hemipteran insect gene that comprises a dsRNA of the invention and an agriculturally acceptable carrier. In one embodiment, inhibition of the expression of a hemipteran or stink bug gene described here leads to cessation of feeding and/or growth and ultimately results in the death of the hemipteran or stink bug.

The invention is further drawn to transgenic plants which produce one or more interfering RNA molecules of the invention that are self-protected from insect feeding damage and to methods of using the plants alone or in combination with other insect control strategies to confer maximal insect control capabilities. Plants and/or plant parts producing one or more interfering RNA molecules of the invention or treated with a composition comprising one or more interfering RNA molecules of the invention are highly resistant to insect pest infestation. For example, economically important hemipteran pests can be controlled by a plant that produces an interfering RNA molecule of the invention or by a plant or plant seed that is treated with a composition comprising an interfering RNA molecule of the invention.

The invention also provides a method of controlling a hemipteran insect plant pest comprising contacting the hemipteran insect with a nucleic acid molecule that is or is capable of producing an interfering RNA of the invention for inhibiting expression of a gene in the hemipteran insect thereby controlling the hemipteran insect.

In other aspects, the invention provides a method of reducing a hemipteran or stink bug population on a transgenic plant expressing a second insecticidal agent, for example an insecticidal protein, in addition to an interfering RNA of the invention capable of inhibiting expression of an target gene in a hemipteran or stink bug, thereby reducing the hemipteran or stink bug population. The second insecticidal agent may be an insecticidal protein derived from *Bacillus thuringiensis*. A *B. thuringiensis* insecticidal protein can be any of a number of insecticidal proteins including but not limited to a Cry1 protein, a Cry3 protein, a Cry7 protein, a Cry8 protein, a Cry11 protein, a Cry22 protein, a Cry 23 protein, a Cry 36 protein, a Cry37 protein, a Cry34 protein together with a Cry35 protein, a binary insecticidal protein CryET33 and CryET34, a binary insecticidal protein TIC100 and TIC101, a binary insecticidal protein PS14961, a VIP, a TIC900 or related protein, a TIC901, TIC1201, TIC407, TIC417, a modified Cry3A protein, or hybrid proteins or chimeras made from any of the preceding insecticidal proteins. In other embodiments, the *B. thuringiensis* insecticidal protein is selected from the group consisting of Cry3Bb1, Cry34Ab1 together with Cry35Ab1, mCry3A and eCry3.1Ab.

In other embodiments, the second insecticidal agent may be derived from sources other than *B. thuringiensis*. The second insecticidal agent can be an agent selected from the group comprising a patatin, a protease, a protease inhibitor, a urease, an alpha-amylase inhibitor, a pore-forming protein, a chitinase, a lectin, an engineered antibody or antibody fragment, a *Bacillus cereus* insecticidal protein, a *Xenorhabdus* spp. (such as *X. nematophila* or *X. bovienii*) insecticidal protein, a *Photorhabdus* spp. (such as *P. luminescens* or *P. asymobiotica*) insecticidal protein, a *Brevibacillus laterosporous* insecticidal protein, a *Lysinibacillus sphearicus* insecticidal protein, a *Chromobacterium* spp. insecticidal protein, a *Yersinia entomophaga* insecticidal protein, a *Paenibacillus popiliae* insecticidal protein, a *Clostridium* spp. (such as *C. bifermentans*) insecticidal protein, a *Alcaligenes* ssp. insecticidal protein, a *Pseudomonas* spp. insecticidal protein, and a lignin. In other embodiments, the second agent may be at least one insecticidal protein derived from an insecticidal toxin complex (Tc) from *Photorhabdus, Xenorhabus, Serratia,* or *Yersinia*. In other embodiments, the insecticidal protein may be an ADP-ribosyltransferase derived from an insecticidal bacteria, such as *Photorhabdus* spp. In other embodiments, the insecticidal protein may be a VIP protein, such as VIP1 or VIP2 from *B. cereus*. In still other embodiments, the insecticidal protein may be a binary toxin derived from an insecticidal bacteria, such as ISP1A and ISP2A from *B. laterosporous* or BinA and BinB from *L. sphaericus*. In still other embodiments, the insecticidal protein may be engineered or may be a hybrid or chimera of any of the preceding insecticidal proteins.

In other aspects, the invention provides a method of reducing the level of a target RNA transcribable from a hemipteran or stink bug gene described herein in a hemipteran or stink bug comprising contacting the hemipteran or stink bug with a composition comprising an interfering RNA molecule of the invention, wherein the interfering RNA molecule reduces the level of the target RNA in a cell of the hemipteran or stink bug.

In still other aspects, the invention provides a method of conferring hemipteran or stink bug tolerance or hemipteran plant pest tolerance to a plant, or part thereof, comprising introducing into the plant, or part thereof, an interfering RNA molecule, a dsRNA molecule, a nucleic acid construct, a chimeric nucleic acid molecule, an artificial plant microRNA precursor molecule and/or a composition of the invention, thereby conferring to the plant or part thereof tolerance to the stink bug or hemipteran plant pest.

In further aspects, the invention provides a method of reducing damage to a plant fed upon by a hemipteran insect, comprising introducing into cells of the plant an interfering RNA molecule, a dsRNA, a nucleic acid molecule, a nucleic acid construct, a chimeric nucleic acid molecule, an artificial plant microRNA precursor molecule and/or a composition of the invention, thereby reducing damage to the plant fed upon by a hemipteran insect.

In other aspects, the invention provides a method of producing a transgenic plant cell having toxicity to a hemipteran insect, comprising introducing into a plant cell an interfering RNA molecule, a dsRNA, a nucleic acid molecule, a nucleic acid construct, a chimeric nucleic acid molecule, an artificial plant microRNA precursor molecule and/or a composition of the invention, thereby producing the transgenic plant cell having toxicity to the hemipteran insect compared to a control plant cell which does not comprise a nucleic acid molecule of the invention.

In further aspects, the invention provides a method of producing a transgenic plant having enhanced tolerance to hemipteran insect feeding damage, comprising introducing into a plant an interfering RNA molecule, a dsRNA, a nucleic acid molecule, a nucleic acid construct, a chimeric nucleic acid molecule, an artificial plant microRNA precursor molecule and/or a composition of the invention, thereby producing a transgenic plant having enhanced tolerance to hemipteran insect feeding damage compared to a control plant which does not comprise a nucleic acid molecule of the invention.

In other aspects, the invention provides a method of enhancing control of a hemipteran insect population comprising providing a transgenic plant or transgenic seed of the invention and applying to the transgenic plant or the transgenic seed a chemical pesticide that is insecticidal to a hemipteran insect, thereby enhancing control of the hemipteran insect population.

In other aspects, the invention provides a method of providing a soybean grower with a means of controlling a hemipteran insect pest population below an economic threshold in a soybean crop comprising (a) selling or providing to the grower transgenic soybean seed comprising a dsRNA, a nucleic acid molecule, a nucleic acid construct, a chimeric nucleic acid molecule, an artificial plant microRNA precursor molecule and/or a composition of the invention; and (b) advertising to the grower that the transgenic soybean seed produces transgenic soybean plants capable of controlling a hemipteran insect pest population.

In another aspect, the invention provides a method of identifying an orthologous target gene for using as a RNAi strategy for the control of a plant pest, said method comprising the steps of: a) producing a primer pair that will amplify a target selected from the group comprising or consisting of SEQ ID NO: 55-162, 700-805; b) amplifying an orthologous target gene from a nucleic acid sample of the plant pest; c) identifying a sequence of an orthologous target gene; d) producing an interfering RNA molecule, wherein the RNA comprises at least one dsRNA, wherein the dsRNA is a region of double-stranded RNA comprising annealed complementary strands, one strand of which comprises a sequence of at least 19 contiguous nucleotides which is at least partially complementary to the orthologous target nucleotide sequence within the target gene; and e) determining if the interfering RNA molecule of step (d) has insecticidal activity on the plant pest. If the interfering RNA has insecticidal activity on the plant pest target gene, an orthologous target gene for using in the control of a plant pest has been identified.

These and other aspects of the invention are set forth in more detail in the description of the invention below.

BRIEF DESCRIPTION OF THE SEQUENCES IN THE SEQUENCE LISTING

The nucleic acid sequences listed in the accompanying sequence listing are shown using standard letter abbreviations for nucleotide bases, as defined in 37 C.F.R. § 1.822. The nucleic acid and amino acid sequences listed define molecules (i.e., polynucleotides and polypeptides, respectively) having the nucleotide and amino acid monomers arranged in the manner described. The nucleic acid and amino acid sequences listed also each define a genus of polynucleotides or polypeptides that comprise the nucleotide and amino acid monomers arranged in the manner described. In view of the redundancy of the genetic code, it will be understood that a nucleotide sequence including a coding sequence also describes the genus of polynucleotides encoding the same polypeptide as a polynucleotide consisting of the reference sequence. It will further be understood that an amino acid sequence describes the genus of polynucleotide ORFS encoding that polypeptide.

Only one strand of each nucleic acid sequence is shown, but the complementary strand is understood as included by any reference to the displayed strand. As the complement and reverse complement of a primary nucleic acid sequence are necessarily disclosed by the primary sequence, the complementary sequence and reverse complementary sequence reference to the nucleic acid sequence, unless it is explicitly stated to be otherwise (or it is clear to be otherwise from the context in which the sequence appears). Furthermore, as it is understood in the art that the nucleotide sequence of an RNA strand is determined by the sequence of the DNA from which it was transcribed (but for the substitution of uracil (U) nucleobases for thymine (T)), an RNA sequence is included by any reference to the DNA sequence encoding it. In the accompanying sequence listing:

SEQ ID NOs: 1-54 are fragments of *Nezara viridula* DNA coding sequences used to synthesize interfering RNA molecules to test for insecticidal activity.

SEQ ID NOs: 55-162 are nucleic acid sequences of primers used to identify target genes from *N. viridula* for testing for insecticidal activity using a RNAi strategy.

SEQ ID NOs: 163-216 are DNA coding sequences of the 54 *N. viridula* target genes identified in the RNAi-based screen for insecticidal activity.

SEQ ID NOs: 217-270 are the sense RNA sequences of the fragments of the *N. viridula* DNA coding sequences used to synthesize interfering RNA molecules to test for insecticidal activity.

SEQ ID NOs: 271-324 are the sense RNA sequences of the *N. viridula* DNA coding sequences of the 54 target genes identified in the RNAi-based screen for insecticidal activity.

SEQ ID NOs: 325-378 are amino acid sequences encoded by the DNA coding sequences of SEQ ID NOs: 163-216.

SEQ ID NOs: 379-431 are DNA coding sequences of *Piezodorus guildinii* orthologs of SEQ ID NOs: 163-216.

SEQ ID NOs: 432-484 are RNA sequences of the DNA coding sequences of the *P. guildinii* SEQ ID NO: 379-431.

SEQ ID NOs: 485-537 are amino acid sequences encoded by the *P. guildinii* DNA coding sequences of SEQ ID NO: 379-431.

SEQ ID NOs: 538-591 are DNA coding sequences of *Halyomorpha halys* orthologs of SEQ ID NOs: 163-216.

SEQ ID NOs: 592-645 are RNA sequences of the *H. halys* DNA coding sequences of SEQ ID NO: 538-591.

SEQ ID NOs: 646-699 are amino acid sequences encoded by the *H. halys* DNA coding sequences of SEQ ID NO: 538-591.

SEQ ID NOs: 700-805 are nucleic acid sequences of primers used to identify target genes from *P. guidinii* for testing for insecticidal activity using a RNAi strategy.

SEQ ID NOs: 806-858 are the sense RNA sequences of the fragments of the *P. guidinii* DNA coding sequences used to synthesize interfering RNA molecules to test for insecticidal activity.

DETAILED DESCRIPTION

The following is a detailed description of the invention provided to aid those skilled in the art in practicing the invention. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments of the invention will be apparent to those skilled in the art in light of the instant disclosure, which do not depart from the invention. Hence, the following descriptions are intended to illustrate some particular embodiments of the invention, and not to exhaustively specify all permutations, combinations and variations thereof. Those of ordinary skill in the art will recognize that modifications and variations in the embodiments described herein may be made without departing from the spirit or scope of the invention.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention. All publications, patent applications, patents, and other references mentioned herein are incorporated by reference in their entirety.

For clarity, certain terms used in the specification are defined and presented as follows:

As used herein, "a," "an" or "the" can mean one or more than one. For example, "a cell" can mean a single cell or a multiplicity of cells.

As used herein, "and/or" refers to and encompasses any and all possible combinations of one or more of the associated listed items, as well as the lack of combinations when interpreted in the alternative (or).

Further, the term "about," as used herein when referring to a measurable value such as an amount of a compound or agent, dose, time, temperature, and the like, is meant to encompass variations of ±20%, ±10%, ±5%, ±1%, ±0.5%, or even ±0.1% of the specified amount.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising." A "coding sequence" is a nucleic acid sequence that is transcribed into RNA such as mRNA, rRNA, tRNA, snRNA, sense RNA or antisense RNA. Preferably the RNA is then translated in an organism to produce a protein.

As used herein, "complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. For example, the sequence "A-G-T" binds to the complementary sequence "T-C-A." It is understood that two polynucleotides may hybridize to each other even if they are not completely complementary to each other, provided that each has at least one region that is substantially complementary to the other.

The terms "complementary" or "complementarity," refer to the natural binding of polynucleotides under permissive salt and temperature conditions by base-pairing. Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

As used herein, the terms "substantially complementary" or "partially complementary" mean that two nucleic acid sequences are complementary at least about 50%, 60%, 70%, 80% or 90% of their nucleotides. In some embodiments, the two nucleic acid sequences can be complementary at least at 85%, 90%, 95%, 96%, 97%, 98%, 99% or more of their nucleotides. The terms "substantially complementary" and "partially complementary" can also mean that two nucleic acid sequences can hybridize under high stringency conditions and such conditions are well known in the art.

As used herein, "dsRNA" refers to a polyribonucleotide structure formed either by a single self-complementary RNA strand or at least by two complementary RNA strands. The degree of complementary, in other words the % identity, need not necessarily be 100%. Rather, it must be sufficient to allow the formation of a double-stranded structure under the conditions employed. As used herein, the term "fully complementary" means that all the bases of the nucleotide sequence of the dsRNA are complementary to or 'match' the bases of the target nucleotide sequence. The term "at least partially complementary" means that there is less than a 100% match between the bases of the dsRNA and the bases of the target nucleotide sequence. The skilled person will understand that the dsRNA need only be at least partially complementary to the target nucleotide sequence in order to mediate down-regulation of expression of the target gene. It is known in the art that RNA sequences with insertions, deletions and mismatches relative to the target sequence can still be effective at RNAi. According to the current invention, it is preferred that the dsRNA and the target nucleotide sequence of the target gene share at least 60% or at least 70% sequence identity, preferably at least 80% or 85% sequence identity. Alternatively, the dsRNA may comprise 1, 2 or 3 mismatches as compared with the target nucleotide sequence over every length of 24 partially complementary nucleotides. It will be appreciated by the person skilled in the art that the degree of complementarity shared between the dsRNA and the target nucleotide sequence may vary depending on the target gene to be down-regulated or depending on the insect pest species in which gene expression is to be controlled.

It will be appreciated that the dsRNA may comprise or consist of a region of double-stranded RNA comprising annealed complementary strands, one strand of which, the sense strand, comprises a sequence of nucleotides at least partially complementary to a target nucleotide sequence within a target gene.

The target nucleotide sequence may be selected from any suitable region or nucleotide sequence of the target gene or RNA transcript thereof. For example, the target nucleotide sequence may be located within the 5'UTR or 3'UTR of the target gene or RNA transcript or within exonic or intronic regions of the gene. The skilled person will be aware of methods of identifying the most suitable target nucleotide sequences within the context of the full-length target gene. For example, multiple dsRNAs targeting different regions of the target gene can be synthesised and tested. Alternatively, digestion of the RNA transcript with enzymes such as RNAse H can be used to determine sites on the RNA that are in a conformation susceptible to gene silencing. Target sites may also be identified using in silico approaches, for example, the use of computer algorithms designed to predict the efficacy of gene silencing based on targeting different sites within the full-length gene.

Preferably, the % identity of a polyribonucleotide is determined by GAP (Needleman and Wunsch, 1970) analysis (GCG program) using the default settings, wherein the query sequence is at least about 19 to about 23 nucleotides in length, and the GAP analysis aligns the two sequences over a region of at least about 21 nucleotides. In another embodiment, the query sequence is at least 150 nucleotides in length, and the GAP analysis aligns the two sequences over a region of at least 150 nucleotides. In a further embodiment, the query sequence is at least 300 nucleotides in length and the GAP analysis aligns the two sequences over a region of at least 300 nucleotides. In yet another embodiment, the query sequence corresponds to the full length of the target RNA, for example mRNA, and the GAP analysis aligns the two sequences over the full length of the target RNA.

Conveniently, the dsRNA can be produced from a single open reading frame in a recombinant host cell, wherein the sense and anti-sense sequences are flanked by an unrelated sequence which enables the sense and anti-sense sequences to hybridize to form the dsRNA molecule with the unrelated sequence forming a loop structure. Alternatively, the sense strand and antisense strand can be made without an open reading frame to ensure that no protein will be made in the transgenic host cell. The two strands can also be expressed separately as two transcripts, one encoding the sense strand and one encoding the antisense strand.

RNA duplex formation can be initiated either inside or outside the cell. The dsRNA can be partially or fully double-stranded. The RNA can be enzymatically or chemically synthesized, either in vitro or in vivo.

The dsRNA need not be full length relative to either the primary transcription product or fully processed RNA. It is well-known in the art that small dsRNA of about 19-23 bp in length can be used to trigger gene silencing of a target gene. Generally, higher identity can be used to compensate for the use of a shorter sequence. Furthermore, the dsRNA can comprise single stranded regions as well, e.g., the dsRNA can be partially or fully double stranded. The double stranded region of the dsRNA can have a length of at least about 19 to about 23 base pairs, optionally a length of about 19 to about 50 base pairs, optionally a length of about 50 to about 100 base pairs, optionally a length of about 100 to about 200 base pairs, optionally a length of about 200 to about 500, and optionally a length of about 500 to about 1000 or more base pairs, up to a molecule that is double stranded for its full length, corresponding in size to a full length target RNA molecule. Bolognesi et al (2012, *PLOS One*, 7(10): e47534, herein incorporated by reference) teach that dsRNAs greater than or equal to about 60 bp are required for biological activity in artificial diet bioassays with Southern Corn Rootworm (SCR; *Diabrotica undecimpunctata howardii*), although the silencing element or target sequence of the dsRNA molecule may be about 21 base pairs. Therefore, it is known in the art that an RNA molecule which comprises a double-stranded region of at least 19, at least 20, or at least 21 base pairs corresponding to the target RNA molecule is efficacious, when it is known that the target gene responds to RNAi.

Mao et al (2007, *Nature Biotechnology*, 35(11): 1307-1313) teach a transgenic plant expressing a dsRNA construct against a target gene (CYP6AE14) of an insect pest (cotton bollworm, *Helicoverpa armigera*). Insects feeding on the transgenic plant have small RNAs of about 19-23 bp in size of the target gene in their midgut, with a corresponding reduction in CYP6AE14 transcripts and protein. This further indicates that it is known in the art that small RNAs are efficacious in reducing expression of the target gene in the insect pest. Therefore, small RNAs of about 19 bp, about 20 bp, about 21 bp, about 22 bp, about 23 bp, about 24 bp, about 25 bp, about 26 bp, about 27 bp, about 28 bp, about 29 bp, or about 30 bp are taught in the art to be efficacious in reducing expression of the target gene in an insect pest.

Further, the dsRNA may comprise a target dsRNA of at least 19 base pairs, and the target dsRNA may be within a dsRNA "carrier" or "filler" sequence. For example, Bolognesi et al (2012) show that a 240 bp dsRNA encompassing a target dsRNA, which comprised a 21 bp contiguous sequence with 100% identity to the target sequence, had biological activity in bioassays with Southern Corn Rootworm. The target dsRNA may have a length of at least 19 to about 25 base pairs, optionally a sequence of about 19 to about 50 base pairs, optionally a sequence of about 50 to about 100 base pairs, optionally a sequence of about 100 to about 200 base pairs, optionally a sequence of about 200 to about 500, and optionally a sequence of about 500 to about 1000 or more base pairs. Combined with the carrier dsRNA sequence, the dsRNA of the target sequence and the carrier dsRNA may have a total length of at least about 50 to about 100 base pairs, optionally a sequence of about 100 to about 200 base pairs, optionally a sequence of about 200 to about 500, and optionally a sequence of about 500 to about 1000 or more base pairs.

The dsRNA can contain known nucleotide analogs or modified backbone residues or linkages, which are synthetic, naturally occurring, and non-naturally occurring. Examples of such analogs include, without limitation, phosphorothioates, phosphoramidates, methyl phosphonates, chiralmethyl phosphonates and 2-O-methyl ribonucleotides.

As used herein, the term "specifically reduce the level of a target RNA and/or the production of a target protein encoded by the RNA", and variations thereof, refers to the sequence of a portion of one strand of the dsRNA being sufficiently identical to the target RNA such that the presence of the dsRNA in a cell reduces the steady state level and/or the production of said RNA. In many instances, the target RNA will be mRNA, and the presence of the dsRNA in a cell producing the mRNA will result in a reduction in the production of said protein. Preferably, this accumulation or production is reduced at least 10%, more preferably at least 50%, even more preferably at least 75%, yet even more preferably at least 95% and most preferably 100%, when compared to a wild-type cell which does not comprise the introduced dsRNA.

The consequences of inhibition can be confirmed by examination of the outward properties of the cell or organism or by biochemical techniques such as, but not limited to, Northern hybridization, reverse transcription, gene expression monitoring with a microarray, antibody binding, enzyme linked immunosorbent assay (ELISA), Western blotting, radioimmunoassay (RIA), and other immunoassays.

The interfering RNAs of the current invention may comprise one dsRNA or multiple dsRNAs, wherein each dsRNA comprises or consists of a sequence of nucleotides which is at least partially complementary to a target nucleotide sequence within the target gene and that functions upon uptake by an insect pest species to down-regulate expression of said target gene. Concatemeric RNA constructs of this type are described in WO2006/046148 (incorporated herein by reference). In the context of the present invention, the term 'multiple' means at least two, at least three, at least four, etc and up to at least 10, 15, 20 or at least 30. In one embodiment, the interfering RNA comprises multiple copies of a single dsRNA i.e. repeats of a dsRNA that binds to a particular target nucleotide sequence within a specific target gene. In another embodiment, the dsRNAs within the interfering RNA comprise or consist of different sequences of nucleotides complementary to different target nucleotide sequences, which may be to different fragments of the same gene or to different target genes. It should be clear that combinations of multiple copies of the same dsRNA combined with dsRNAs binding to different target nucleotide sequences are within the scope of the current invention.

The dsRNAs may be arranged as one contiguous region of the interfering RNA or may be separated by the presence of linker sequences. The linker sequence may comprise a short random nucleotide sequence that is not complementary to any target nucleotide sequences or target genes. In one embodiment, the linker is a conditionally self-cleaving RNA sequence, preferably a pH-sensitive linker or a hydrophobic-sensitive linker. In one embodiment, the linker comprises a sequence of nucleotides equivalent to an intronic sequence. Linker sequences of the current invention may range in length from about 1 base pair to about 10000 base pairs, provided that the linker does not impair the ability of the interfering RNA to down-regulate the expression of target gene(s).

In addition to the dsRNA(s) and any linker sequences, the interfering RNA of the invention may comprise at least one additional polynucleotide sequence. In different embodiments of the invention, the additional sequence is chosen from (i) a sequence capable of protecting the interfering RNA against RNA processing, (ii) a sequence affecting the stability of the interfering RNA, (iii) a sequence allowing protein binding, for example to facilitate uptake of the interfering RNA by cells of the insect pest species, (iv) a sequence facilitating large-scale production of the interfering RNA, (v) a sequence which is an aptamer that binds to a receptor or to a molecule on the surface of the insect pest cells to facilitate uptake, or (vi) a sequence that catalyses processing of the interfering RNA within the insect pest cells and thereby enhances the efficacy of the interfering RNA. Structures for enhancing the stability of RNA molecules are well known in the art and are described further in WO2006/046148 as incorporated herein by reference.

The interfering RNA may contain DNA bases, non-natural bases or non-natural backbone linkages or modifications of the sugar-phosphate backbone, for example to enhance stability during storage or enhance resistance to degradation by nucleases. Furthermore, the interfering RNA may be produced chemically or enzymatically by one skilled in the art through manual or automated reactions. Alternatively, the interfering RNA may be transcribed from a polynucleotide encoding the same. Thus, provided herein is an isolated polynucleotide encoding any of the interfering RNAs of the current invention.

MicroRNAs (miRNAs) are non-protein coding RNAs, generally of between about 18 to about 25 nucleotides in length (commonly about 20-24 nucleotides in length in plants). These miRNAs direct cleavage in trans of target transcripts, negatively regulating the expression of genes involved in various regulation and development pathways (Bartel, *Cell*, 116:281-297 (2004); Zhang et al. *Dev. Biol.* 289:3-16 (2006)). As such, miRNAs have been shown to be involved in different aspects of plant growth and development as well as in signal transduction and protein degradation. In addition, small endogenous mRNAs including miRNAs may also be involved in biotic stress responses such as pathogen attack. Since the first miRNAs were discovered in plants (Reinhart et al. *Genes Dev.* 16:1616-1626 (2002), Park et al. *Curr. Biol.* 12:1484-1495 (2002)) many hundreds have been identified. Furthermore, many plant miRNAs have been shown to be highly conserved across very divergent taxa. (Floyd et al. *Nature* 428:485-486 (2004); Zhang et al. *Plant J.* 46:243-259 (2006)). Many microRNA genes (MIR genes) have been identified and made publicly available in a database (miRBase, available via the world wide web). miRNAs are also described in U.S. Patent Publications 2005/0120415 and 2005/0144669A1, the entire contents of which are incorporated by reference herein.

Genes encoding miRNAs yield primary miRNAs (termed a "pri-miRNA") of 70 to 300 bp in length that can form imperfect stem-loop structures. A single pri-miRNA may contain from one to several miRNA precursors. In animals, pri-miRNAs are processed in the nucleus into shorter hairpin RNAs of about 65 nt (pre-miRNAs) by the RNaseIII enzyme Drosha and its cofactor DGCR8/Pasha. The pre-miRNA is then exported to the cytoplasm, where it is further processed by another RNaseIII enzyme, Dicer, releasing a miRNA/miRNA* duplex of about 22 nt in size. In contrast to animals, in plants, the processing of pri-miRNAs into mature miRNAs occurs entirely in the nucleus using a single RNaseIII enzyme, DCL1 (Dicer-like 1). (Zhu. *Proc. Natl. Acad. Sci.* 105:9851-9852 (2008)). Many reviews on microRNA biogenesis and function are available, for example, see, Bartel *Cell* 116:281-297 (2004), Murchison et al. *Curr. Opin. Cell Biol.* 16:223-229 (2004), Dugas et al. *Curr. Opin. Plant Biol.* 7:512-520 (2004) and Kim *Nature Rev. Mol. Cell Biol.* 6:376-385 (2005).

The term "plant microRNA precursor molecule" as used herein describes a small (~70-300 nt) non-coding RNA sequence that is processed by plant enzymes to yield a ~19-24 nucleotide product known as a mature microRNA sequence. The mature sequences have regulatory roles through complementarity to messenger RNA (mRNA). The term "artificial plant microRNA precursor molecule" describes the non-coding miRNA precursor sequence prior to processing that is employed as a backbone sequence for the delivery of a siRNA molecule via substitution of the endogenous native miRNA/miRNA* duplex of the miRNA precursor molecule with that of a non-native, heterologous miRNA (amiRNA/amiRNA*; e.g. siRNA/siRNA*) that is then processed into the mature miRNA sequence with the siRNA sequence.

In the context of the invention, the term "toxic" used to describe a dsRNA of the invention means that the dsRNA molecules of the invention and combinations of such dsRNA molecules function as orally active insect control agents that have a negative effect on an insect. When a composition of the invention is delivered to the insect, the result is typically death of the insect, or the insect does not feed upon the source that makes the composition available to the insect. Such a composition may be a transgenic plant expressing the dsRNA of the invention.

To "control" or "controlling" insects means to inhibit, through a toxic effect, the ability of one or more insect pests to survive, grow, feed, and/or reproduce, or to limit insect-related damage or loss in crop plants. To "control" insects may or may not mean killing the insects, although it preferably means killing the insects. A composition that controls a target insect has insecticidal activity against the target insect.

To "deliver" or "delivering" a composition or dsRNA means that the composition or dsRNA comes in contact with an insect, resulting in a toxic effect and control of the insect. The composition or dsRNA can be delivered in many recognized ways, e.g., orally by ingestion by the insect via transgenic plant expression, formulated composition(s), sprayable composition(s), a bait matrix, or any other art-recognized toxicant delivery system.

The term "insect" as used herein includes any organism now known or later identified that is classified in the animal kingdom, phylum Arthropoda, class Insecta, including but not limited to insects in the orders Coleoptera (beetles), Lepidoptera (moths, butterflies), Diptera (flies), Protura, Collembola (springtails), Diplura, Microcoryphia (jumping bristletails), Thysanura (bristletails, silverfish), Ephemeroptera (mayflies), Odonata (dragonflies, damselflies), Orthoptera (grasshoppers, crickets, katydids), Phasmatodea (walkingsticks), Grylloblattodea (rock crawlers), Mantophasmatodea, Dermaptera (earwigs), Plecoptera (stoneflies), Embioptera (web spinners), Zoraptera, Isoptera (termites), Mantodea (mantids), Blattodea (cockroaches), Hemiptera (true bugs, cicadas, leafhoppers, aphids, scales), Thysanoptera (thrips), Psocoptera (book and bark lice), Phthiraptera (lice; including but not limited to suborders Amblycera, Ischnocera and Anoplura), Neuroptera (lacewings, owlflies, mantispids, antlions), Hymenoptera (bees, ants, wasps), Trichoptera (caddisflies), Siphonaptera (fleas), Mecoptera (scorpion flies), Strepsiptera (twisted-winged parasites), and any combination thereof.

As used herein, the terms "hemipteran insect" or "hemipteran pest" refer to insects of the order hemipteran: heteroptera and include but are not limited to the families Pentatomidae, Miridae, Pyrrhocoridae, Coreidae, Alydidae, and Rhopalidae, which feed on a wide range of host plants and have piercing and sucking mouth parts. In particular examples, a hemipteran pest is selected from the list comprising *Euschistus* spp. (for example *E. servus* (Brown Stink Bug), *E. heros* (Neotropical Brown Stink Bug)), *Nezara* spp. (for example *N. antennata, N. hilare,* and *N. viridula* (Southern Green Stink Bug)), *Piezodorus* spp. (for example *P. guildinii* (Red-banded Stink Bug)), *Halyomorpha* spp. (for example *H. halys* (Brown Marmorated Stink Bug)), *Chinavia* spp. (for example *C. marginatum, C. hilare* (Green Stink Bug)), *Dichelops* spp. (for example *D. melacanthus, Dichelops furcatus*), *Edessa* spp. (for example *E. meditabunda*), *Thyanta* spp. (for example *T. perditor* (Neotropical Red Shouldered Stink Bug)), *Horcias* spp. (for example *H. nobilellus* (Cotton Bug)), *Taedia* spp. for example *T. stigmosa*), *Dysdercus* spp. (for example *D. peruvianus*), *Neomegalotomus* spp. (for example *N. parvus*), *Leptoglossus* spp. (for example *L. zonatus*), *Niesthrea* spp. (for example *N. sidae*), *Eurygaster* spp. (for example *E. intergriceps, E. maura*), *Oebalus* spp. (for example *O. mexicana, O. poecilus,* and *O. pugnase*) *Scotinophara* spp. (for example *S. lurida, S. coarctata*), and *Lygus* spp. (for example *L. hesperus* (Western Tarnished Plant Bug), *L. lineolaris*).

As used herein, the term "Pentatomidae plant pest" is used to refer to any member of the Pentatomidae family. Accordingly, the compositions and methods are also useful in protecting plants against any Pentatomidae plant pest including representative genera and species such as, but not limited to, *Acrocorisellus* (*A. serraticollis*), *Acrosternum* (*A. adelpha, A. hilare, A. herbidum, A. scutellatum*), *Agonoscelis* (*A. nubila*), *Alcaeorrhynchus* (*A. grandis, A. phymatophorus*), *Amaurochrous* (*A. brevitylus*), *Apateticus* (*A. anatarius, A. bracteatus, A. cynicus, A. lineolatus, A. marginiventris*), *Apoecilus*, *Arma* (*A. custos*), *Arvelius*, *Bagrada*, *Banasa* (*B. calva, B. dimiata, B. grisea, B. induta, B. sordida*), *Brochymena* (*B. ajjnnis, B. cariosa, B. haedula, B. hoppingi, B. sulcata*), *Carbula* (*C. obtusangula, C. sinica*), *Chinavia*, *Chlorochroa* (*C. belfragii, C. kanei, C. norlandi, C. senilis, C. viridicata*), *Chlorocoris* (*C. distinctus, C. flaviviridis, C. hebetatus, C. subrugosus, C. tau*), *Codophila* (*C. remota, C. sulcata, C. varius*), *Coenus* (*C. delius, C. inermis, C. tarsalis*), *Cosmopepla* (*C. bimaculata, C. binotata, C. carnifex, C. decorata, C. intergressus*), *Dalpada* (*D. oculata*), *Dendrocoris* (*D. arizonesis, D. fruticicola, D. humeralis, D. parapini, D. reticulatus*), *Dolycoris* (*D. baccarum* (sloe bug)), *Dybowskyia* (*D. reticulata*), *Edessa*, *Erthesina* (*E. fullo*), *Eurydema* (*E. dominulus, E. gebleri* (shield bug), *E. pulchra, E. rugosa*), *Euschistus* (*E. biformis, E. integer, E. quadrator, E. servus, E. tristigma*), *Euthyrhynchus* (*E. floridanus, E. macronemis*), *Gonopsis* (*G. coccinea*), *Graphosoma* (*G. lineatum* (stink bug), *G. rubrolineatum*), *Elalyomorpha* (*El. halys* (brown marmorated stink bug)), *Elalys* (*El. sindillus, H. sulcatus*), *Holcostethus* (*H. abbreviate, H. fulvipes, H. limbolarius, H. piceus, H. sphacelatus*), *Homalogonia* (*H. obtusa*), *Hymenarcys* (*H. aequalis, H. crassa, H. nervosa, H. perpuncata, H. reticulata*), *Lelia* (*L. decempunctata*), *Lineostethus*, *Loxa* (*L. flavicollis, L. viridis*), *Mecidea* (*M. indicia, M. major, M. minor*), *Megarrhamphus* (*M. hastatus*), *Menecles* (*M. insertus, M. portacrus*), *Mormidea* (*M. cubrosa, M. lugens, M. pama, M. pictiventris, M. ypsilon*), *Moromorpha* (*M. tetra*), *Murgantia* (*M. angularis, M. tessellata, M. varicolor, M. violascens*), *Neottiglossa* (*N. californica, N. cavifrons, N. coronaciliata, N. sulcifrons, N. undata*), *Nezara* (*N. smaragdulus, N. viridula* (southern green stink bug)), *Oebalus* (*O. grisescens, O. insularis, O. mexicanus, O. pugnax, O. typhoeus*), *Oechalia* (*O. schellenbergii* (spined predatory shield bug)), *Okeanos* (*O. quelpartensis*), *Oplomus* (*O. catena, O. dichrous, O. tripustulatus*), *Palomena* (*P. prasina* (green shield bug)), *Parabrochymena*, *Pentatoma* (*P. angulata, P. illuminata, P. japonica, P. kunmingensis, P. metallifera, P. parataibaiensis, P. rufipes, P. semiannulata, P. viridicornuta*), *Perillus* (*P. bioculatus, P. confluens, P. strigipes*), *Picromerus* (*P. griseus*), *Piezodorus* (*P. degeeri, P. guildinii, P. lituratus* (gorse shield bug)), *Pinthaeus* (*P. humeralis*), *Plautia* (*P. crossota, P. stali* (brown-winged green bug)), *Podisus* (*P. maculiventris*), *Priassus* (*P. testaceus*), *Prionosoma*, *Proxys* (*P. albopunctulatus, P. punctulatus, P. victor*), *Rhaphigaster* (*R. nebulosa*), *Scotinophara* (*S. horvathi*), *Stiretrus* (*S. anchorage, S. fimbriatus*), *Thyanta* (*T. accerra, T. calceata, T. casta, T. perditor, T. pseudocasta*), *Trichopepla* (*T. aurora, T. dubia, T. pilipes, T. semivittata, T. vandykei*), *Tylospilus*, and *Zicrona*.

"Effective insect-controlling amount" means that concentration of dsRNA that inhibits, through a toxic effect, the ability of insects to survive, grow, feed and/or reproduce, or to limit insect-related damage or loss in crop plants. "Effective insect-controlling amount" may or may not mean a concentration that kills the insects, although it preferably means that it kills the insects. In some embodiments, application of an insecticidally effective amount of the polynucleotide, such as a dsRNA molecule, to a plant improves the plant's resistance to infestation by the insect. In some embodiments, application of an insecticidally effective amount of the polynucleotide, such as a dsRNA molecule, to a crop plant improves yield (e.g., increased biomass, increased seed or fruit production, or increased oil, starch, sugar, or protein content) of that crop plant, in comparison to a crop plant not treated with the polynucleotide. While there is no upper limit on the concentrations and dosages of a polynucleotide as described herein that can be useful in the methods and compositions provided herein, lower effective concentrations and dosages will generally be sought for efficiency and economy.

Non-limiting embodiments of effective amounts of a polynucleotide include a range from about 10 nano grams per milliliter to about 100 micrograms per milliliter of a polynucleotide in a liquid form sprayed on a plant, or from about 10 milligrams per acre to about 100 grams per acre of polynucleotide applied to a field of plants, or from about 0.001 to about 0.1 microgram per milliliter of polynucleotide in an artificial diet for feeding the insect. Where compositions as described herein are topically applied to a plant, the concentrations can be adjusted in consideration of the volume of spray or treatment applied to plant leaves or other plant part surfaces, such as flower petals, stems, tubers, fruit, anthers, pollen, leaves, roots, or seeds. In one embodiment, a useful treatment for herbaceous plants using 25-mer polynucleotides is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a single-stranded polynucleotide as described herein are applied. In certain embodiments, about 0.5 nmol to about 2 nmol of a dsRNA as described herein is applied. In certain embodiments, a composition containing about 0.5 to about 2.0 milligrams per milliliter, or about 0.14 milligrams per milliliter of a dsRNA (or a single-stranded 21-mer) as described herein is applied. In certain embodiments, a composition of about 0.5 to about 1.5 milligrams per milliliter of a dsRNA polynucleotide as described herein of about 50 to about 200 or more nucleotides is applied. In certain embodiments, about 1 nmol to about 5 nmol of a dsRNA as described herein is applied to a plant. In certain embodiments, the polynucleotide composition as topically applied to the plant contains at least one polynucleotide as described herein at a concentration of about 0.01 to about 10 milligrams per milliliter, or about 0.05 to about 2 milligrams per milliliter, or about 0.1 to about 2 milligrams per milliliter. Very large plants, trees, or vines can require correspondingly larger amounts of polynucleotides. When using long dsRNA molecules that can be processed into multiple oligonucleotides (e.g., multiple triggers encoded by a single recombinant DNA molecule as disclosed herein) lower concentrations can be used. Non-limiting examples of effective polynucleotide treatment regimes include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

The term "agrochemically active ingredient" refers to chemicals and/or biological compositions, such as those described herein, which are effective in killing, preventing, or controlling the growth of undesirable pests, such as, plants, insects, mice, microorganism, algae, fungi, bacteria, and the like (such as pesticidally active ingredients). An interfering RNA molecule of the invention is an agrochemically active ingredient.

An "agriculturally acceptable carrier" includes adjuvants, mixers, enhancers, etc. beneficial for application of an active ingredient, such as an interfering RNA molecule of the invention. Suitable carriers should not be phytotoxic to valuable crops, particularly at the concentrations employed in applying the compositions in the presence of crops, and should not react chemically with the compounds of the active ingredient herein, namely an interfering RNA of the invention, or other composition ingredients. Such mixtures can be designed for application directly to crops, or can be concentrates or formulations which are normally diluted with additional carriers and adjuvants before application. They may include inert or active components and can be solids, such as, for example, dusts, granules, water dispersible granules, or wettable powders, or liquids, such as, for example, emulsifiable concentrates, solutions, emulsions or suspensions. Suitable agricultural carriers may include liquid carriers, for example water, toluene, xylene, petroleum naphtha, crop oil, acetone, methyl ethyl ketone, cyclohexanone, trichloroethylene, perchloroethylene, ethyl acetate, amyl acetate, butyl acetate, propylene glycol monomethyl ether and diethylene glycol monomethyl ether, methanol, ethanol, isopropanol, amyl alcohol, ethylene glycol, propylene glycol, glycerine, and the like. Water is generally the carrier of choice for the dilution of concentrates. Suitable solid carriers may include talc, pyrophyllite clay, silica, attapulgus clay, kieselguhr, chalk, diatomaceous earth, lime, calcium carbonate, bentonire clay, Fuller's earth, cotton seed hulls, wheat flour, soybean flour, pumice, wood flour, walnut shell flour, lignin, and the like.

It is recognized that the polynucleotides comprising sequences encoding the silencing element can be used to transform organisms to provide for host organism production of these components, and further used for subsequent application of the host organism to the environment of the target pest(s). In this manner, the combination of polynucleotides encoding the silencing element may be introduced via a suitable vector into a microbial host, and said host applied to the environment, or to plants or animals.

For the present invention, the microbial host may be considered an agriculturally acceptable carrier for an interfering RNA molecule of the invention, which is the insect control agent. The microbial host may be non-pathogenic, attenuated, or heat-inactivated strains of microorganisms, or compositions derived therefrom. The microbial host may be microorganisms including bacteria, algae, and fungi. The microorganisms may be engineered to express a nucleotide sequence of a target gene to produce interfering RNA molecules comprising RNA sequences homologous or complementary to RNA sequences typically found within the cells of an insect. Exposure of the insects to the microorganisms results in ingestion of the microorganisms and down-regulation of expression of target genes mediated directly or indirectly by the interfering RNA molecules or fragments or derivatives thereof.

Further, microbial hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the sequences encoding the interfering RNA molecule of the invention, and desirably, provide for improved protection of the components from environmental degradation and inactivation.

Of particular interest are microorganisms such as bacteria, e.g., *Pseudomonas, Erwinia, Serratia, Klebsiella, Escherichia, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*; fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum, Agrobacteria* spp., *Rhodopseudomonas spheroides, Xanthomonas campestris, Rhizobium melioti, Alcaligenes entrophus, Clavibacter xyli* and *Azotobacter vinlandir*, and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae*, and *Aureobasidium pollulans*.

A number of ways are available for introducing the polynucleotide comprising the silencing element into the microbial host under conditions that allow for stable maintenance and expression of such nucleotide encoding sequences. For example, expression cassettes can be constructed which include the nucleotide constructs of interest operably linked with the transcriptional and translational regulatory signals for expression of the nucleotide constructs, and a nucleotide sequence homologous with a sequence in the host organism, whereby integration will occur, and/or a replication system that is functional in the host, whereby integration or stable maintenance will occur.

Transcriptional and translational regulatory signals include, but are not limited to, promoters, transcriptional initiation start sites, operators, activators, enhancers, other regulatory elements, ribosomal binding sites, an initiation codon, termination signals, and the like. Methods for the production of expression constructs comprising such regulatory signals are well known in the art; see for example Sambrook et al. (2000); Molecular Cloning: A Laboratory Manual (3rd ed.; Cold Spring Harbor Laboratory Press, Plainview, N.Y.); Davis et al. (1980) Advanced Bacterial Genetics (Cold Spring Harbor Laboratory, Cold Spring Harbor, N.Y.); and the references cited therein.

Suitable host cells include the prokaryotes and the lower eukaryotes, such as fungi. Illustrative prokaryotes, both Gram-negative and Gram-positive, include Enterobacteriaceae, such as *Escherichia, Erwinia, Shigella, Salmonella*, and *Proteus*; Bacillaceae; Rhizobiceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae and Nitrobacteraceae. Among eukaryotes are fungi, such as *Phycomycetes* and *Ascomycetes*, which includes yeast such as *Saccharomyces* and *Schizosaccharomyces*; and *Basidiomycetes* yeast, such as *Rhodotorula, Aureobasidium, Sporobolomyces*, and the like.

Characteristics of particular interest in selecting a host cell for purposes of the invention include ease of introducing the coding sequence into the host, availability of expression systems, efficiency of expression, RNA stability in the host, and the presence of auxiliary genetic capabilities. Characteristics of interest for use as a pesticide microcapsule include protective qualities, such as thick cell walls, pigmentation, and intracellular packaging or formation of inclusion bodies; leaf affinity; lack of mammalian toxicity; attractiveness to pests for ingestion; and the like. Other considerations include ease of formulation and handling, economics, storage stability, and the like.

Host organisms of particular interest include yeast, such as *Rhodotorula* spp., *Aureobasidium* spp., *Saccharomyces* spp., and *Sporobolomyces* spp., phylloplane organisms such as *Pseudomonas* spp., *Erwinia* spp., and *Flavobacterium* spp., and other such organisms, including *Pseudomonas aeruginosa, Pseudomonas fluorescens, Saccharomyces cerevisiae, Bacillus thuringiensis, Escherichia coli, Bacillus subtilis*, and the like.

The sequences encoding the interfering RNA molecules encompassed by the invention can be introduced into microorganisms that multiply on plants (epiphytes) to deliver these components to potential target pests. Epiphytes, for example, can be gram-positive or gram-negative bacteria.

An interfering RNA molecule of the invention can be fermented in a bacterial host and the resulting bacteria processed, and used as a microbial spray in the same manner that *Bacillus thuringiensis* strains have been used as insecticidal sprays. Any suitable microorganism can be used for this purpose. *Pseudomonas* spp. have been used to express *Bacillus thuringiensis* endotoxins as encapsulated proteins and the resulting cells processed and sprayed as an insecticide (Gaertner et al. 1993. *Advanced Engineered Pesticides*, ed. L. Kim (Marcel Decker, Inc.). *E. coli* is also well-known in the art for expressing molecules of interest as part during a fermentation process. In some embodiments, the resulting bacteria is processed by heat inactivation. In some embodiments, heat inactivation kills the bacteria but does not degrade the produced RNA molecules. The resulting compositions may then be formulated in accordance with conventional techniques for application to the environment hosting a target pest, e.g., soil, water, and foliage of plants.

The transformed microorganisms carrying an interfering RNA molecule of the invention may also be referred to as insect control agents. The microorganisms may be engineered to express a nucleotide sequence of a target gene to produce interfering RNA molecules comprising RNA sequences homologous or complementary to RNA sequences typically found within the cells of an insect. Exposure of the insects to the microorganisms result in ingestion of the microorganisms and down-regulation of expression of target genes mediated directly or indirectly by the interfering RNA molecules or fragments or derivatives thereof.

In the present invention, a transformed microorganism can be formulated with an agriculturally acceptable carrier into separate or combined compositions that are, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention (i.e., at least one interfering RNA molecule) are normally applied in the form of compositions and can be applied to the crop area, plant, or seed to be treated. For example, the compositions may be applied to grain in preparation for or during storage in a grain bin or silo, etc. The compositions may be applied simultaneously or in succession with other compounds. Methods of applying an active ingredient or a composition that contains at least one interfering RNA molecule include, but are not limited to, foliar application, seed coating, and soil application. The number of applications and the rate of application depend on the intensity of infestation by the corresponding pest.

To apply a compound of the invention as an insecticide, acaricide, nematicide or molluscicide to a pest, a locus of pest, or to a plant susceptible to attack by a pest, compounds of the invention are usually formulated into a composition which includes, in addition to the compound of the invention, a suitable inert diluent or carrier and, optionally, a surface active agent (SFA). SFAs are chemicals which are able to modify the properties of an interface (for example, liquid/solid, liquid/air or liquid/liquid interfaces) by lowering the interfacial tension and thereby leading to changes in other properties (for example dispersion, emulsification and wetting). It is preferred that all compositions (both solid and liquid formulations) comprise, by weight, 0.0001 to 95%, more preferably 1 to 85%, for example 5 to 60%, of a compound of the invention. The composition is generally used for the control of pests such that a compound of the invention is applied at a rate of from 0.1 g to10 kg per hectare, preferably from 1 g to 6 kg per hectare, more preferably from 1 g to 1 kg per hectare.

Suitable surface-active agents include, but are not limited to, anionic compounds such as a carboxylate of, for example, a metal; carboxylate of a long chain fatty acid; an N-acylsarcosinate; mono- or di-esters of phosphoric acid with fatty alcohol ethoxylates or salts of such esters; fatty alcohol sulfates such as sodium dodecyl sulfate, sodium octadecyl sulfate, or sodium cetyl sulfate; ethoxylated fatty alcohol sulfates; ethoxylated alkylphenol sulfates; lignin sulfonates; petroleum sulfonates; alkyl aryl sulfonates such as alkylbenzene sulfonates or lower alkylnaphthalene sulfonates, e.g., butyl-naphthalene sulfonate; salts of sulfonated naphthaleneformaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate or dioctyl succinate. Nonionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitan fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include, but are not limited to inorganic minerals such as kaolin, phyllosilicates, carbonates, sulfates, phosphates, or botanical materials such as cork, powdered corncobs, peanut hulls, rice hulls, and walnut shells.

The compositions comprising an interfering RNA molecule of the invention can be in a suitable form for direct application or as a concentrate of primary composition that requires dilution with a suitable quantity of water or other dilutant before application. The compositions (including the transformed microorganisms) can be applied to the environment of an insect pest (such as a hemipteran insect) by, for example, spraying, atomizing, dusting, scattering, coating or pouring, introducing into or on the soil, introducing into irrigation water, by seed treatment or general application or dusting at the time when the pest has begun to appear or before the appearance of pests as a protective measure. For example, the composition(s) and/or transformed microorganism(s) may be mixed with grain to protect the grain during storage. It is generally important to obtain good control of pests in the early stages of plant growth, as this is the time when the plant can be most severely damaged.

Application of the compounds of the invention is preferably to a crop of soybean plants, the locus thereof (for example, a field where the soybean plants are or will be planted or where soybean seeds are or will be planted), or propagation material thereof. Preferably application is to a crop of soybean plants or the locus thereof, more preferably to a crop of soybean plants. Application may be before infestation or when the pest is present. Application of the compounds of the invention can be performed according to any of the usual modes of application, e.g. foliar, drench, soil, in furrow etc. However, control of stinkbugs is usually achieved by foliar application, which is the preferred mode of application according to the invention.

The compounds of the invention may be applied in combination with an attractant. An attractant is a chemical that causes the insect to migrate towards the location of application. For control of stinkbugs it can be advantageous to apply the compounds of the invention with an attractant, particularly when the application is foliar. Stinkbugs are often located near to the ground, and application of an attractant may encourage migration up the plant towards the active ingredient. Suitable attractants include glucose, sacchrose, salt, glutamate (e.g. Aji-no-motor™), citric acid (e.g. Orobor™), soybean oil, peanut oil and soybean milk. Glutamate and citric acid are of particular interest, with citric acid being preferred.

An attractant may be premixed with the compound of the invention prior to application, e.g. as a readymix or tankmix, or by simultaneous application or sequential application to the plant. Suitable rates of attractants are for example 0.02 kg/ha-3 kg/ha.

The compositions can conveniently contain another insecticide if this is thought necessary. In an embodiment of the invention, the composition(s) is applied directly to the soil, at a time of planting, in granular form of a composition of a carrier and dead cells of a *Bacillus* strain or transformed microorganism of the invention. Another embodiment is a granular form of a composition comprising an agrochemical such as, for example, a herbicide, an insecticide, a fertilizer, in an inert carrier, and dead cells of a *Bacillus* strain or live or dead cells of transformed microorganisms of the invention.

In another embodiment, the interfering RNA molecules may be encapsulated in a synthetic matrix such as a polymer and applied to the surface of a host such as a plant. Ingestion of the host cells by an insect permits delivery of the insect control agents to the insect and results in down-regulation of a target gene in the host.

A composition of the invention, for example a composition comprising an interfering RNA molecule of the invention and an agriculturally acceptable carrier, may be used in conventional agricultural methods. For example, the compositions of the invention may be mixed with water and/or fertilizers and may be applied preemergence and/or postemergence to a desired locus by any means, such as airplane spray tanks, irrigation equipment, direct injection spray equipment, knapsack spray tanks, cattle dipping vats, farm equipment used in ground spraying (e.g., boom sprayers, hand sprayers), and the like. The desired locus may be soil, plants, and the like.

A composition of the invention may be applied to a seed or plant propagule in any physiological state, at any time between harvest of the seed and sowing of the seed; during or after sowing; and/or after sprouting. It is preferred that the seed or plant propagule be in a sufficiently durable state that it incurs no or minimal damage, including physical damage or biological damage, during the treatment process. A formulation may be applied to the seeds or plant propagules using conventional coating techniques and machines, such as fluidized bed techniques, the roller mill method, rotostatic seed treaters, and drum coaters.

When used in a seed dressing, a compound of the invention is used at a rate of 0.0001 g to 10 g (for example 0.001 g or 0.05 g), preferably 0.005 g to 10 g, more preferably 0.005 g to 4 g, per kilogram of seed.

Compositions comprising a compound of the invention can be chosen from a number of formulation types, including dustable powders (DP), soluble powders (SP), water soluble granules (SG), water dispersible granules (WG), wettable powders (WP), granules (GR) (slow or fast release), soluble concentrates (SL), oil miscible liquids (OL), ultra low volume liquids (UL), emulsifiable concentrates (EC), dispersible concentrates (DC), emulsions (both oil in water (EW) and water in oil (EO)), micro-emulsions (ME), suspension concentrates (SC), aerosols, fogging/smoke formulations, capsule suspensions (CS) and seed treatment formulations. The formulation type chosen in any instance will depend upon the particular purpose envisaged and the physical, chemical and biological properties of the compound of the invention.

Dustable powders (DP) may be prepared by mixing a compound of the invention with one or more solid diluents (for example natural clays, kaolin, pyrophyllite, bentonite, alumina, montmorillonite, kieselguhr, chalk, diatomaceous earths, calcium phosphates, calcium and magnesium carbonates, sulfur, lime, flours, talc and other organic and inorganic solid carriers) and mechanically grinding the mixture to a fine powder.

Soluble powders (SP) may be prepared by mixing a compound of the invention with one or more water-soluble inorganic salts (such as sodium bicarbonate, sodium carbonate or magnesium sulfate) or one or more water-soluble organic solids (such as a polysaccharide) and, optionally, one or more wetting agents, one or more dispersing agents or a mixture of said agents to improve water dispersibility/solubility. The mixture is then ground to a fine powder. Similar compositions may also be granulated to form water soluble granules (SG).

Wettable powders (WP) may be prepared by mixing a compound of the invention with one or more solid diluents or carriers, one or more wetting agents and, preferably, one or more dispersing agents and, optionally, one or more suspending agents to facilitate the dispersion in liquids. The mixture is then ground to a fine powder. Similar compositions may also be granulated to form water dispersible granules (WG).

Granules (GR) may be formed either by granulating a mixture of a compound of the invention and one or more powdered solid diluents or carriers, or from pre-formed blank granules by absorbing a compound of the invention (or a solution thereof, in a suitable agent) in a porous granular material (such as pumice, attapulgite clays, fuller's earth, kieselguhr, diatomaceous earths or ground corn cobs) or by adsorbing a compound of the invention (or a solution thereof, in a suitable agent) on to a hard core material (such as sands, silicates, mineral carbonates, sulfates or phosphates) and drying if necessary. Agents which are commonly used to aid absorption or adsorption include solvents (such as aliphatic and aromatic petroleum solvents, alcohols, ethers, ketones and esters) and sticking agents (such as polyvinyl acetates, polyvinyl alcohols, dextrins, sugars and vegetable oils). One or more other additives may also be included in granules (for example an emulsifying agent, wetting agent or dispersing agent).

Dispersible Concentrates (DC) may be prepared by dissolving a compound of the invention in water or an organic solvent, such as a ketone, alcohol or glycol ether. These solutions may contain a surface active agent (for example to improve water dilution or prevent crystallization in a spray tank).

Emulsifiable concentrates (EC) or oil-in-water emulsions (EW) may be prepared by dissolving a compound of the invention in an organic solvent (optionally containing one or more wetting agents, one or more emulsifying agents or a mixture of said agents). Suitable organic solvents for use in ECs include aromatic hydrocarbons (such as alkylbenzenes or alkylnaphthalenes, exemplified by SOLVESSO 100, SOLVESSO 150 and SOLVESSO 200; SOLVESSO is a Registered Trade Mark), ketones (such as cyclohexanone or methylcyclohexanone) and alcohols (such as benzyl alcohol, furfuryl alcohol or butanol), N-alkylpyrrolidones (such as N-methylpyrrolidone or N-octylpyrrolidone), dimethyl amides of fatty acids (such as $C_8$-$C_{10}$ fatty acid dimethylamide) and chlorinated hydrocarbons. An EC product may spontaneously emulsify on addition to water, to produce an emulsion with sufficient stability to allow spray application through appropriate equipment. Preparation of an EW involves obtaining a compound of the invention either as a liquid (if it is not a liquid at room temperature, it may be melted at a reasonable temperature, typically below 70° C.) or in solution (by dissolving it in an appropriate solvent) and then emulsifying the resultant liquid or solution into water containing one or more SFAs, under high shear, to produce an emulsion. Suitable solvents for use in EWs include vegetable oils, chlorinated hydrocarbons (such as chlorobenzenes), aromatic solvents (such as alkylbenzenes or alkylnaphthalenes) and other appropriate organic solvents which have a low solubility in water.

Microemulsions (ME) may be prepared by mixing water with a blend of one or more solvents with one or more SFAs, to produce spontaneously a thermodynamically stable isotropic liquid formulation. A compound of the invention is present initially in either the water or the solvent/SFA blend. Suitable solvents for use in MEs include those hereinbefore described for use in ECs or in EWs. An ME may be either an oil-in-water or a water-in-oil system (which system is present may be determined by conductivity measurements) and may be suitable for mixing water-soluble and oil-soluble pesticides in the same formulation. An ME is suitable for dilution into water, either remaining as a microemulsion or forming a conventional oil-in-water emulsion.

Suspension concentrates (SC) may comprise aqueous or non-aqueous suspensions of finely divided insoluble solid particles of a compound of the invention. SCs may be prepared by ball or bead milling the solid compound of the invention in a suitable medium, optionally with one or more dispersing agents, to produce a fine particle suspension of the compound. One or more wetting agents may be included in the composition and a suspending agent may be included to reduce the rate at which the particles settle. Alternatively, a compound of the invention may be dry milled and added to water, containing agents hereinbefore described, to produce the desired end product.

Aerosol formulations comprise a compound of the invention and a suitable propellant (for example n-butane). A compound of the invention may also be dissolved or dispersed in a suitable medium (for example water or a water miscible liquid, such as n-propanol) to provide compositions for use in non-pressurized, hand-actuated spray pumps.

A compound of the invention may be mixed in the dry state with a pyrotechnic mixture to form a composition suitable for generating, in an enclosed space, a smoke containing the compound.

Capsule suspensions (CS) may be prepared in a manner similar to the preparation of EW formulations but with an additional polymerization stage such that an aqueous dispersion of oil droplets is obtained, in which each oil droplet is encapsulated by a polymeric shell and contains a compound of the invention and, optionally, a carrier or diluent therefor. The polymeric shell may be produced by either an interfacial polycondensation reaction or by a coacervation procedure. The compositions may provide for controlled release of the compound of the invention and they may be used for seed treatment. A compound of the invention may also be formulated in a biodegradable polymeric matrix to provide a slow, controlled release of the compound.

A composition may include one or more additives to improve the biological performance of the composition (for example by improving wetting, retention or distribution on surfaces; resistance to rain on treated surfaces; or uptake or mobility of a compound of the invention). Such additives include surface active agents, spray additives based on oils, for example certain mineral oils or natural plant oils (such as soy bean and rape seed oil), and blends of these with other bio-enhancing adjuvants (ingredients which may aid or modify the action of a compound of the invention).

A compound of the invention may also be formulated for use as a seed treatment, for example as a powder composition, including a powder for dry seed treatment (DS), a water soluble powder (SS) or a water dispersible powder for slurry treatment (WS), or as a liquid composition, including a flowable concentrate (FS), a solution (LS) or a capsule suspension (CS). The preparations of DS, SS, WS, FS and LS compositions are very similar to those of, respectively, DP, SP, WP, SC and DC compositions described above. Compositions for treating seed may include an agent for assisting the adhesion of the composition to the seed (for example a mineral oil or a film-forming barrier).

Wetting agents, dispersing agents and emulsifying agents may be surface SFAs of the cationic, anionic, amphoteric or non-ionic type.

Suitable SFAs of the cationic type include quaternary ammonium compounds (for example cetyltrimethyl ammonium bromide), imidazolines and amine salts.

Suitable anionic SFAs include alkali metals salts of fatty acids, salts of aliphatic monoesters of sulfuric acid (for example sodium lauryl sulfate), salts of sulfonated aromatic compounds (for example sodium dodecylbenzenesulfonate, calcium dodecylbenzenesulfonate, butylnaphthalene sulfonate and mixtures of sodium di-isopropyl- and tri-isopropyl-naphthalene sulfonates), ether sulfates, alcohol ether sulfates (for example sodium laureth-3-sulfate), ether carboxylates (for example sodium laureth-3-carboxylate), phosphate esters (products from the reaction between one or more fatty alcohols and phosphoric acid (predominately mono-esters) or phosphorus pentoxide (predominately di-esters), for example the reaction between lauryl alcohol and tetraphosphoric acid; additionally these products may be ethoxylated), sulfosuccinamates, paraffin or olefine sulfonates, taurates and lignosulfonates.

Suitable SFAs of the amphoteric type include betaines, propionates and glycinates.

Suitable SFAs of the non-ionic type include condensation products of alkylene oxides, such as ethylene oxide, propylene oxide, butylene oxide or mixtures thereof, with fatty alcohols (such as oleyl alcohol or cetyl alcohol) or with alkylphenols (such as octylphenol, nonylphenol or octyl-cresol); partial esters derived from long chain fatty acids or hexitol anhydrides; condensation products of said partial esters with ethylene oxide; block polymers (comprising ethylene oxide and propylene oxide); alkanolamides; simple esters (for example fatty acid polyethylene glycol esters); amine oxides (for example lauryl dimethyl amine oxide); and lecithins.

Suitable suspending agents include hydrophilic colloids (such as polysaccharides, polyvinylpyrrolidone or sodium carboxymethylcellulose) and swelling clays (such as bentonite or attapulgite).

A compound of the invention may be applied by any of the known means of applying pesticidal compounds. For example, it may be applied, formulated or unformulated, to the pests or to a locus of the pests (such as a habitat of the pests, or a growing plant liable to infestation by the pests) or to any part of the plant, including the foliage, stems, branches or roots, to the seed before it is planted or to other media in which plants are growing or are to be planted (such as soil surrounding the roots, the soil generally, paddy water or hydroponic culture systems), directly or it may be sprayed on, dusted on, applied by dipping, applied as a cream or paste formulation, applied as a vapor or applied through distribution or incorporation of a composition (such as a granular composition or a composition packed in a water-soluble bag) in soil or an aqueous environment.

A compound of the invention may also be injected into plants or sprayed onto vegetation using electrodynamic spraying techniques or other low volume methods, or applied by land or aerial irrigation systems.

Compositions for use as aqueous preparations (aqueous solutions or dispersions) are generally supplied in the form of a concentrate containing a high proportion of the active ingredient, the concentrate being added to water before use. These concentrates, which may include DCs, SCs, ECs, EWs, MEs, SGs, SPs, WPs, WGs and CSs, are often required to withstand storage for prolonged periods and, after such storage, to be capable of addition to water to form aqueous preparations which remain homogeneous for a sufficient time to enable them to be applied by conventional spray equipment. Such aqueous preparations may contain varying amounts of a compound of the invention (for example 0.0001 to 10%, by weight) depending upon the purpose for which they are to be used.

A compound of the invention may be used in mixtures with fertilizers (for example nitrogen-, potassium- or phosphorus-containing fertilizers). Suitable formulation types include granules of fertilizer. The mixtures preferably contain up to 25% by weight of the compound of the invention.

The invention therefore also provides a fertilizer composition comprising a fertilizer and a compound of the invention.

The compositions of this invention may contain other compounds having biological activity, for example micronutrients or compounds having fungicidal activity or which possess plant growth regulating, herbicidal, insecticidal, nematicidal or acaricidal activity.

The compound of the invention may be the sole active ingredient of the composition or it may be admixed with one or more additional active ingredients such as a pesticide, fungicide, synergist, herbicide or plant growth regulator where appropriate. An additional active ingredient may: provide a composition having a broader spectrum of activity or increased persistence at a locus; synergize the activity or complement the activity (for example by increasing the speed of effect or overcoming repellency) of the compound of the invention; or help to overcome or prevent the development of resistance to individual components. The particular additional active ingredient will depend upon the intended utility of the composition. Examples of suitable pesticides include the following:

a) Pyrethroids, such as permethrin, cypermethrin, fenvalerate, esfenvalerate, deltamethrin, cyhalothrin (in particular lambda-cyhalothrin and gamma cyhalothrin), bifenthrin, fenpropathrin, cyfluthrin, tefluthrin, fish safe pyrethroids (for example ethofenprox), natural pyrethrin, tetramethrin, S-bioallethrin, fenfluthrin, prallethrin, acrinathirin, etofenprox or 5-benzyl-3-furylmethyl-(E)-(1R,3S)-2,2-dimethyl-3-(2-oxothiolan-3-ylidenemethyl)cyclopropane carboxylate;

b) Organophosphates, such as profenofos, sulprofos, acephate, methyl parathion, azinphos-methyl, demeton-s-methyl, heptenophos, thiometon, fenamiphos, monocrotophos, profenofos, triazophos, methamidophos, dimethoate, phosphamidon, malathion, chlorpyrifos, phosalone, terbufos, fensulfothion, fonofos, phorate, phoxim, pirimiphos-methyl, pirimiphos-ethyl, fenitrothion, fosthiazate or diazinon;

c) Carbamates (including aryl carbamates), such as pirimicarb, triazamate, cloethocarb, carbofuran, furathiocarb, ethiofencarb, aldicarb, thiofurox, carbosulfan, bendiocarb, fenobucarb, propoxur, methomyl or oxamyl;

d) Benzoyl ureas, such as diflubenzuron, triflumuron, hexaflumuron, flufenoxuron, diafenthiuron, lufeneron, novaluron, noviflumuron or chlorfluazuron;

e) Organic tin compounds, such as cyhexatin, fenbutatin oxide or azocyclotin;

f) Pyrazoles, such as tebufenpyrad, tolfenpyrad, ethiprole, pyriprole, fipronil, and fenpyroximate;

g) Macrolides, such as avermectins or milbemycins, for example abamectin, emamectin benzoate, ivermectin, milbemycin, spinosad, azadirachtin, milbemectin, lepimectin or spinetoram;

h) Hormones or pheromones;

i) Organochlorine compounds, such as endosulfan (in particular alpha-endosulfan), benzene hexachloride, DDT, chlordane or dieldrin;

j) Amidines, such as chlordimeform or amitraz;

k) Fumigant agents, such as chloropicrin, dichloropropane, methyl bromide or metam;

l) Neonicotinoid compounds, such as imidacloprid, thiacloprid, acetamiprid, nitenpyram, dinotefuran, thiamethoxam, clothianidin, or nithiazine;

m) Diacylhydrazines, such as tebufenozide, chromafenozide or methoxyfenozide;

n) Diphenyl ethers, such as diofenolan or pyriproxifen;

o) Ureas such as Indoxacarb or metaflumizone;

p) Ketoenols, such as Spirotetramat, spirodiclofen or spiromesifen;

q) Diamides, such as flubendiamide, chlorantraniliprole (Rynaxypyr®) or cyantraniliprole;

r) Essential oils such as Bugoil®-(PlantImpact); or s) a compound selected from buprofezine, flonicamid, acequinocyl, bifenazate, cyenopyrafen, cyflumetofen, etoxazole, flometoquin, fluacrypyrim, fluensulfone, flufenerim, flupyradifuone, harpin, iodomethane, dodecadienol, pyridaben, pyridalyl, pyrimidifen, flupyradifurone, 4-[(6-Chloropyridin-3-ylmethyl)-(2,2-difluoro-ethyl)-amino]-5H-furan-2-one (DE 102006015467), CAS: 915972-17-7 (WO 2006129714; WO 2011/147953; WO 2011/147952), CAS: 26914-55-8 (WO 2007/020986), chlorfenapyr, pymetrozine, sulfoxaflor and pyrifluquinazon.

In addition to the major chemical classes of pesticide listed above, other pesticides having particular targets may be employed in the composition, if appropriate for the intended utility of the composition. For instance, selective insecticides for particular crops, for example stemborer specific insecticides (such as cartap) or hopper specific insecticides (such as buprofezin) for use in rice may be employed. Alternatively insecticides or acaricides specific for particular insect species/stages may also be included in the compositions (for example acaricidal ovo-larvicides, such as clofentezine, flubenzimine, hexythiazox or tetradifon; acaricidal motilicides, such as dicofol or propargite; acaricides, such as bromopropylate or chlorobenzilate; or growth regulators, such as hydramethylnon, cyromazine, methoprene, chlorfluazuron or diflubenzuron).

Examples of fungicidal compounds which may be included in the composition of the invention are (E)-N-methyl-2-[2-(2,5-dimethylphenoxymethyl)phenyl]-2-methoxy-iminoacetamide (SSF-129), 4-bromo-2-cyano-N,N-dimethyl-6-trifluoromethylbenzimidazole-1-sulfonamide, α-[N-(3-chloro-2,6-xylyl)-2-methoxyacetamido]-γ-butyrolactone, 4-chloro-2-cyano-N,N-dimethyl-5-p-tolylimidazole-1-sulfonamide (IKF-916, cyamidazosulfamid), 3-5-dichloro-N-(3-chloro-1-ethyl-1-methyl-2-oxopropyl)-4-methylbenzamide (RH-7281, zoxamide), N-allyl-4,5,-dimethyl-2-trimethylsilylthiophene-3-carboxamide (MON65500), N-(1-cyano-1,2-dimethylpropyl)-2-(2,4-dichlorophenoxy)propionamide (AC382042), N-(2-methoxy-5-pyridyl)-cyclopropane carboxamide, acibenzolar (CGA245704), alanycarb, aldimorph, anilazine, azaconazole, azoxystrobin, benalaxyl, benomyl, biloxazol, bitertanol, blasticidin S, bromuconazole, bupirimate, captafol, captan, carbendazim, carbendazim chlorhydrate, carboxin, carpropamid, carvone, CGA41396, CGA41397, chinomethionate, chlorothalonil, chlorozolinate, clozylacon, copper containing compounds such as copper oxychloride, copper oxyquinolate, copper sulfate, copper tallate and Bordeaux mixture, cymoxanil, cyproconazole, cyprodinil, debacarb, di-2-pyridyl disulfide 1,1'-dioxide, dichlofluanid, diclomezine, dicloran, diethofencarb, difenoconazole, difenzoquat, diflumetorim, O,O-di-iso-propyl-S-benzyl thiophosphate, dimefluazole, dimetconazole, dimethomorph, dimethirimol, diniconazole, dinocap, dithianon, dodecyl dimethyl ammonium chloride, dodemorph, dodine, doguadine, edifenphos, epoxiconazole, ethirimol, ethyl-(Z)-N-benzyl-N-([methyl(methyl-thioethylideneaminooxycarbonyl)amino]thio)-β-alaninate, etridiazole, famoxadone, fenamidone (RPA407213), fenarimol, fenbuconazole, fenfuram, fenhexamid (KBR2738), fenpiclonil, fenpropidin, fenpropimorph, fentin acetate, fentin hydroxide, ferbam, ferimzone, fluazinam, fludioxonil, flumetover, fluoroimide, fluquinconazole, flusilazole, flutolanil, flutriafol, folpet, fuberidazole, furalaxyl, furametpyr, guazatine, hexaconazole, hydroxyisoxazole, hymexazole, imazalil, imibenconazole, iminoctadine, iminoctadine triacetate, ipconazole, iprobenfos, iprodione, iprovalicarb (SZX0722), isopropanyl butyl carbamate, isoprothiolane, kasugamycin, kresoxim-methyl, LY186054, LY211795, LY248908, mancozeb, maneb, mefenoxam, mepanipyrim, mepronil, metalaxyl, metconazole, metiram, metiram-zinc, metominostrobin, myclobutanil, neoasozin, nickel dimethyldithiocarbamate, nitrothal-iso-propyl, nuarimol, ofurace, organomercury compounds, oxadixyl, oxasulfuron, oxolinic acid, oxpoconazole, oxycarboxin, pefurazoate, penconazole, pencycuron, phenazin oxide, phosetyl-Al, phosphorus acids, phthalide, picoxystrobin (ZA1963), polyoxin D, polyram, probenazole, prochloraz, procymidone, propamocarb, propiconazole, propineb, propionic acid, pyrazophos, pyrifenox, pyrimethanil, pyroquilon, pyroxyfur, pyrrolnitrin, quaternary ammonium compounds, quinomethionate, quinoxyfen, quintozene, sipconazole (F-155), sodium pentachlorophenate, spiroxamine, streptomycin, sulfur, tebuconazole, tecloftalam, tecnazene, tetraconazole, thiabendazole, thifluzamid, 2-(thiocyanomethylthio)benzothiazole, thiophanate-methyl, thiram, timibenconazole, tolclofos-methyl, tolylfluanid, triadimefon, triadimenol, triaz-butil, triazoxide, tricyclazole, tridemorph, trifloxystrobin (CGA279202), triforine, triflumizole, triticonazole, validamycin A, vapam, vinclozolin, zineb, ziram; N-[9-(dichloromethylene)-1,2,3, 4-tetrahydro-1,4-methanonaphthalen-5-yl]-3-(difluoromethyl)-1-methyl-1H-pyrazole-4-carboxamide [1072957-71-1], 1-methyl-3-difluoromethyl-1H-pyrazole-4-carboxylic acid (2-dichloromethylene-3-ethyl-1-methyl-indan-4-yl)-amide, and 1-methyl-3-difluoromethyl-4H-pyrazole-4-carboxylic acid [2-(2,4-dichloro-phenyl)-2-methoxy-1-methylethyl]-amide.

Preferred additional pesticidally active ingredients are those selected from neonicotinoids, pyrethroids, strobilurins, triazoles and carboxamides (SDHI inhibitors). Pyrethroids are of interest of which lambda-cyhalothrin is of particular interest. Combinations of compounds of the invention and pyrethroids, in parrticular lambda-cyhalothrin, exhibit synergistic control of stinkbugs (according to the Colby formula), in particular *Euschistus*, e.g. *Euschistus heros*.

In a further aspect of the invention there is provided a method comprising applying to a crop of soybean plants, the locus thereof, or propagation material thereof, a combination of a compound a compound of the invention and lambda cyhalothrin in a synergistically effective amount, wherein the method is for control and/or prevention of stinkbugs, preferably *Euschistus*, e.g. *Euschistus heros*.

The compounds of the invention may be mixed with soil, peat or other rooting media for the protection of plants against seed-borne, soil-borne or foliar fungal diseases.

Examples of suitable synergists for use in the compositions include piperonyl butoxide, sesamex, safroxan and dodecyl imidazole.

Suitable herbicides and plant-growth regulators for inclusion in the compositions will depend upon the intended target and the effect required.

An example of a rice selective herbicide which may be included is propanil. An example of a plant growth regulator for use in cotton is PIX™.

Some mixtures may comprise active ingredients which have significantly different physical, chemical or biological properties such that they do not easily lend themselves to the same conventional formulation type. In these circumstances other formulation types may be prepared. For example, where one active ingredient is a water insoluble solid and the other a water insoluble liquid, it may nevertheless be possible to disperse each active ingredient in the same continuous aqueous phase by dispersing the solid active ingredient as a suspension (using a preparation analogous to that of an SC) but dispersing the liquid active ingredient as an emulsion (using a preparation analogous to that of an EW). The resultant composition is a suspoemulsion (SE) formulation.

Unless otherwise stated the weight ratio of the compound of I with an additional active ingredient may generally be between 1000:1 and 1:1000. In other embodiments that weight ratio of A to B may be between 500:1 to 1:500, for example between 100:1 to 1:100, for example between 1:50 to 50:1, for example 1:20 to 20:1, for example 1:10 to 10:1, for example 1:5 to 5:1, for example 1:1.

Compositions of the invention include those prepared by premixing prior to application, e.g. as a readymix or tankmix, or by simultaneous application or sequential application to the plant.

"Expression cassette" as used herein means a nucleic acid sequence capable of directing expression of a particular nucleic acid sequence in an appropriate host cell, comprising a promoter operably linked to the nucleic acid sequence of interest which is operably linked to termination signal sequences. It also typically comprises sequences required for proper translation of the nucleic acid sequence. The expression cassette comprising the nucleic acid sequence of interest may be chimeric, meaning that at least one of its components is heterologous with respect to at least one of its other components. The expression cassette may also be one that is naturally occurring but has been obtained in a recombinant form useful for heterologous expression. Typically, however, the expression cassette is heterologous with respect to the host, i.e., the particular nucleic acid sequence of the expression cassette does not occur naturally in the host cell and must have been introduced into the host cell or an ancestor of the host cell by a transformation event. The expression of the nucleic acid sequence in the expression cassette may be under the control of, for example, a constitutive promoter or of an inducible promoter that initiates transcription only when the host cell is exposed to some particular external stimulus. In the case of a multicellular organism, such as a plant, the promoter can also be specific to a particular tissue, or organ, or stage of development.

A "gene" is a defined region that is located within a genome and that, besides the aforementioned coding sequence, comprises other, primarily regulatory nucleic acid sequences responsible for the control of the expression, that is to say the transcription and translation, of the coding portion. A gene may also comprise other 5' and 3' untranslated sequences and termination sequences. Further elements that may be present are, for example, introns.

As used herein, the term "grower" means a person or entity that is engaged in agriculture, raising living organisms, such as crop plants, for example soybean, for food, feed or raw materials.

A "heterologous" nucleic acid sequence is a nucleic acid sequence not naturally associated with a host cell into which it is introduced, including non-naturally occurring multiple copies of a naturally occurring nucleic acid sequence.

A "homologous" nucleic acid sequence is a nucleic acid sequence naturally associated with a host cell into which it is introduced.

"Insecticidal" is defined as a toxic biological activity capable of controlling insects, preferably by killing them.

An "isolated" nucleic acid molecule or nucleotide sequence or nucleic acid construct or dsRNA molecule or protein of the invention is generally exists apart from its native environment and is therefore not a product of nature. An isolated nucleic acid molecule or nucleotide sequence or nucleic acid construct or dsRNA molecule or protein may exist in a purified form or may exist in a non-native environment such as, for example, a recombinant host or host cell such as a transgenic plant or transgenic plant cell.

In the context of the invention, a number in front of the suffix "mer" indicates a specified number of subunits. When applied to RNA or DNA, this specifies the number of bases in the molecule. For example, a 19 nucleotide subsequence of an mRNA having the sequence UGAAAUGGCUGUUGGUCUU is a "19-mer" of SEQ ID NO: 217.

A "plant" is any plant at any stage of development, particularly a seed plant.

A "plant cell" is a structural and physiological unit of a plant, comprising a protoplast and a cell wall. The plant cell may be in the form of an isolated single cell or a cultured cell, or as a part of a higher organized unit such as, for example, plant tissue, a plant organ, or a whole plant.

"Plant cell culture" means cultures of plant units such as, for example, protoplasts, cell culture cells, cells in plant tissues, pollen, pollen tubes, ovules, embryo sacs, zygotes and embryos at various stages of development.

"Plant material" refers to leaves, stems, roots, flowers or flower parts, fruits, pollen, egg cells, zygotes, seeds, cuttings, cell or tissue cultures, or any other part or product of a plant.

A "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

A "transcriptome" is a collection of all or nearly all the ribonucleic acid (RNA) transcripts in a cell or group of cells, such as a tissue or cell culture.

"Transformation" is a process for introducing heterologous nucleic acid into a host cell or organism. In particular, "transformation" means the stable integration of a DNA molecule into the genome of an organism of interest.

"Transformed/transgenic/recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. The nucleic acid molecule can also be introduced into the genome of the chloroplast or the mitochondria of a plant cell or eukaryotic cell. Transformed cells, tissues, or plants are understood to encompass not only the end product of a transformation process, but also transgenic progeny thereof. A "non-transformed", "non-transgenic", or "non-recombinant" host refers to a wild-type organism, e.g., a bacterium or plant, which does not contain the heterologous nucleic acid molecule.

The nomenclature used herein for DNA or RNA bases and amino acids is as set forth in 37 C.F.R. § 1.822.

The invention is based on the unexpected discovery that double stranded RNA (dsRNA) or small interfering RNAs (siRNA) designed to target a mRNA transcribable from the stink bug genes described herein are toxic to the stink bug pest and can be used to control stink bug or hemipteran infestation of a plant and impart to a transgenic plant tolerance to a stink bug or hemipteran infestation. Thus, in one embodiment, the invention provides a double stranded RNA (dsRNA) molecule comprising a sense strand and an antisense strand, wherein a nucleotide sequence of the antisense strand is complementary to a portion of a mRNA polynucleotide transcribable from a stink bug gene described in the present disclosure, wherein the dsRNA molecule is toxic to a stink bug or hemipteran plant pest.

It is known in the art that dsRNA molecules that are not perfectly complementary to a target sequence (for example, having only 95% identity to the target gene) are effective to control insect pests (see, for example, Narva et al., U.S. Pat. No. 9,012,722). The invention provides an interfering RNA molecule comprising at least one dsRNA, where the dsRNA is a region of double-stranded RNA comprising annealed at least partially complementary strands. One strand of the dsRNA comprises a sequence of at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 contiguous nucleotides which is at least partially complementary to a target nucleotide sequence within a stink bug spp target gene. The interfering RNA molecule (i) has at least 60% identity, at least 65% identity, at least 70% identity, at least 75% identity, at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of a nucleotide sequence encoding an amino acid sequence encoded by SEQ ID NO: 217-324, SEQ ID NO: 432-484, SEQ ID NO: 592-645, SEQ ID NO: 806-858 or the complement thereof, wherein the interfering RNA molecule has insecticidal activity on a hemipteran plant pest.

In some embodiments, the interfering RNA molecule comprises at least two dsRNAs, wherein each dsRNA comprises a sequence of nucleotides which is at least partially complementary to a target nucleotide sequence within the target gene. In some embodiments, each of the dsRNAs comprise a different sequence of nucleotides which is complementary to a different target nucleotide sequence within the target gene. In other embodiments, each of the dsRNAs comprise a different sequence of nucleotides which is complementary to a target nucleotide sequence within two different target genes.

In some embodiments, the interfering RNA molecule comprises a dsRNA that can comprise, consist essentially of or consist of from at least 19 to about 25 consecutive nucleotides (e.g. 18, 19, 20, 21, 22, 23, 24, 25, 26, 27, 28, or 29) to at least about 300 consecutive nucleotides. Additional nucleotides can be added at the 3' end, the 5' end or both the 3' and 5' ends to facilitate manipulation of the dsRNA molecule but that do not materially affect the basic characteristics or function of the dsRNA molecule in RNA interference (RNAi).

In some embodiments, the interfering RNA molecule comprises a dsRNA which comprises an antisense strand that is complementary to at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides of SEQ ID NO: 217-324, SEQ ID NO: 432-484, SEQ ID NO: 592-645, SEQ ID NO: 806-858. In other embodiments, the portion of dsRNA comprises, consists essentially of or consists of at least from 19, 20 or 21 consecutive nucleotides to at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides of SEQ ID NO: 217-324, SEQ ID NO: 432-484, SEQ ID NO: 592-645, SEQ ID NO: 806-858, or the complement thereof.

In other embodiments, an interfering RNA molecule of the invention comprises a dsRNA which comprises, consists essentially of or consists of any 19-mer subsequence of SEQ ID NO: 217-324, SEQ ID NO: 432-484, SEQ ID NO: 592-645, SEQ ID NO: 806-858 consisting of N to N+18 nucleotides, or any complement thereof. For example, an interfering RNA molecule of the invention comprises a dsRNA which comprises, consist essentially of or consists of any 19-mer subsequence of SEQ ID NO: 271, wherein N is nucleotide 1 to nucleotide 336 of SEQ ID NO: 271, or any complement thereof. In other words, the portion of the mRNA that is targeted comprises any of the 336 19-mers (a 19-mer refers to 19 consecutive nucleotides) subsequences of SEQ ID NO: 271, or any of their complementing sequences. It will be recognized that these 336 19-mer subsequences include all possible 19-mer subsequences from SEQ ID NO: 271 and from SEQ ID NO: 217, and their complements, as SEQ ID NOs 217 and 271 are to the same target, namely Nv_CG7622. It will similarly be recognized that all 19-mer subsequences of SEQ ID NO: 217-324, SEQ ID NO: 432-484, SEQ ID NO: 592-645, SEQ ID NO: 806-858, and all complement subsequences thereof, include all possible 19-mer subsequences of SEQ ID NO: 217-324, SEQ ID NO: 432-484, SEQ ID NO: 592-645, SEQ ID NO: 806-858, and the complement subsequences thereof.

Similarly, an interfering RNA molecule of the invention comprises a dsRNA which comprises, consist essentially of or consists of any 19-mer subsequence of SEQ ID NO: 272, wherein N is nucleotide 1 to nucleotide 663 of SEQ ID NO: 272, or any complement thereof. Another interfering RNA molecule of the invention comprises a dsRNA which comprises, consist essentially of or consists of any 19-mer subsequence of SEQ ID NO: 273, wherein N is nucleotide 1 to nucleotide 357 of SEQ ID NO: 273, or any complement thereof. Another interfering RNA molecule of the invention comprises a dsRNA which comprises, consist essentially of or consists of any 19-mer subsequence of SEQ ID NO: 274, wherein N is nucleotide 1 to nucleotide 1275 of SEQ ID NO: 274, or any complement thereof. Another interfering RNA molecule of the invention comprises a dsRNA which comprises, consist essentially of or consists of any 19-mer subsequence of SEQ ID NO: 275, wherein N is nucleotide 1 to nucleotide 369 of SEQ ID NO: 275, or any complement thereof. Another interfering RNA molecule of the invention comprises a dsRNA which comprises, consist essentially of or consists of any 19-mer subsequence of SEQ ID NO: 276, wherein N is nucleotide 1 to nucleotide 1170 of SEQ ID NO: 276, or any complement thereof. Another interfering RNA molecule of the invention comprises a dsRNA which comprises, consist essentially of or consists of any 19-mer subsequence of SEQ ID NO: 277, wherein N is nucleotide 1 to nucleotide 1233 of SEQ ID NO: 277, or any complement thereof. Another interfering RNA molecule of the invention comprises a dsRNA which comprises, consist essentially of or consists of any 19-mer subsequence of SEQ ID NO: 278, wherein N is nucleotide 1 to nucleotide 462 of SEQ ID NO: 278, or any complement thereof. Another interfering RNA molecule of the invention comprises a dsRNA which comprises, consist essentially of or consists of any 19-mer subsequence of SEQ ID NO: 279, wherein N is nucleotide 1 to nucleotide 639 of SEQ ID NO: 279, or any complement thereof. Another interfering RNA molecule of the invention comprises a dsRNA which comprises, consist essentially of or consists of any 19-mer subsequence of SEQ ID NO: 280, wherein N is nucleotide 1 to nucleotide 672 of SEQ ID NO: 280, or any complement thereof. Another interfering RNA molecule of the invention comprises a dsRNA which comprises, consist essentially of or consists of any 19-mer subsequence of SEQ ID NO: 281, wherein N is nucleotide 1 to nucleotide 1113 of SEQ ID NO: 281, or any complement thereof. Another interfering RNA molecule of the invention comprises a dsRNA which comprises, consist essentially of or consists of any 19-mer subsequence of SEQ ID NO: 282, wherein N is nucleotide 1 to nucleotide 1113 of SEQ ID NO: 282, or any complement thereof. Another interfering RNA molecule of the invention comprises a dsRNA which comprises, consist essentially of or consists of any 19-mer subsequence of SEQ ID NO: 283, wherein N is nucleotide 1 to nucleotide 1500 of SEQ ID NO: 283, or any complement thereof. Another interfering RNA molecule of the invention comprises a dsRNA which comprises, consist essentially of or consists of any 19-mer subsequence of SEQ ID NO: 284, wherein N is nucleotide 1 to nucleotide 1251 of SEQ ID NO: 284, or any complement thereof. Another interfering RNA molecule of the invention comprises a dsRNA which comprises, consist essentially of or consists of any 19-mer subsequence of SEQ ID NO: 285, wherein N is nucleotide 1 to nucleotide 774 of SEQ ID NO: 285, or any complement thereof. Another interfering RNA molecule of the invention comprises a dsRNA which comprises, consist essentially of or consists of any 19-mer subsequence of SEQ ID NO: 286, wherein N is nucleotide 1 to nucleotide 2391 of SEQ ID NO: 286, or any complement thereof. Another interfering RNA molecule of the invention comprises a dsRNA which comprises, consist essentially of or consists of any 19-mer subsequence of SEQ ID NO: 287, wherein N is nucleotide 1 to nucleotide 2974 of SEQ ID NO: 287, or any complement thereof. Another interfering RNA molecule of the invention comprises a dsRNA which comprises, consist essentially of or consists of any 19-mer subsequence of SEQ ID NO: 288, wherein N is nucleotide 1 to nucleotide 432 of SEQ ID NO: 288, or any complement thereof. Another interfering RNA molecule of the invention comprises a dsRNA which comprises, consist essentially of or consists of any 19-mer subsequence of SEQ ID NO: 289, wherein N is nucleotide 1 to nucleotide 4587 of SEQ ID NO: 289, or any complement thereof. Another interfering RNA molecule of the invention comprises a dsRNA which comprises, consist essentially of or consists of any 19-mer subsequence of SEQ ID NO: 290, wherein N is nucleotide 1 to nucleotide 1089 of SEQ ID NO: 290, or any complement thereof. Another interfering RNA molecule of the invention comprises a dsRNA which comprises, consist essentially of or consists of any 19-mer subsequence of SEQ ID NO: 291, wherein N is nucleotide 1 to nucleotide 834 of SEQ ID NO: 291, or any complement thereof. Another interfering RNA molecule of the invention comprises a dsRNA which comprises, consist essentially of or consists of any 19-mer subsequence of SEQ ID NO: 292, wherein N is nucleotide 1 to nucleotide 771 of SEQ ID NO: 292, or any complement thereof. Another interfering RNA molecule of the invention comprises a dsRNA which comprises, consist essentially of or consists of any 19-mer subsequence of SEQ ID NO: 293, wherein N is nucleotide 1 to nucleotide 645 of SEQ ID NO: 293, or any complement thereof. Another interfering RNA molecule of the invention comprises a dsRNA which comprises, consist essentially of or consists of any 19-mer subsequence of SEQ ID NO: 294, wherein N is nucleotide 1 to nucleotide 696 of SEQ ID NO: 294, or any complement thereof. Another interfering RNA molecule of the invention comprises a dsRNA which comprises, consist essentially of or consists of any 19-mer subsequence of SEQ ID NO: 295, wherein N is nucleotide 1 to nucleotide 336 of SEQ ID NO: 295, or any complement thereof. Another interfering RNA molecule of the invention comprises a dsRNA which comprises, consist essentially of or consists of any 19-mer subsequence of SEQ ID NO: 296, wherein N is nucleotide 1 to nucleotide 639 of SEQ ID NO: 296, or any complement thereof. Another interfering RNA molecule of the invention comprises a dsRNA which comprises, consist essentially of or consists of any 19-mer subsequence of SEQ ID NO: 297, wherein N is nucleotide 1 to nucleotide 438 of SEQ ID NO: 297, or any complement thereof. Another interfering RNA molecule of the invention comprises a dsRNA which comprises, consist essentially of or consists of any 19-mer subsequence of SEQ ID NO: 298, wherein N is nucleotide 1 to nucleotide 1266 of SEQ ID NO: 298, or any complement thereof. Another interfering RNA molecule of the invention comprises a dsRNA which comprises, consist essentially of or consists of any 19-mer subsequence of SEQ ID NO: 299, wherein N is nucleotide 1 to nucleotide 597 of SEQ ID NO: 299, or any complement thereof. Another interfering RNA molecule of the invention comprises a dsRNA which comprises, consist essentially of or consists of any 19-mer subsequence of SEQ ID NO: 300, wherein N is nucleotide 1 to nucleotide 3525 of SEQ ID NO: 300, or any complement thereof. Another interfering RNA molecule of the invention comprises a dsRNA which comprises, consist essentially of or consists of any 19-mer subsequence of SEQ ID NO: 301, wherein N is nucleotide 1 to nucleotide 393 of SEQ ID NO: 301, or any complement thereof. Another interfering RNA molecule of the invention comprises a dsRNA which comprises, consist essentially of or consists of any 19-mer subsequence of SEQ ID NO: 302, wherein N is nucleotide 1 to nucleotide 492 of SEQ ID NO: 302, or any complement thereof. Another interfering RNA molecule of the invention comprises a dsRNA which comprises, consist essentially of or consists of any 19-mer subsequence of SEQ ID NO: 303, wherein N is nucleotide 1 to nucleotide 5856 of SEQ ID NO: 303, or any complement thereof. Another interfering RNA molecule of the invention comprises a dsRNA which comprises, consist essentially of or consists of any 19-mer subsequence of SEQ ID NO: 304, wherein N is nucleotide 1 to nucleotide 750 of SEQ ID NO: 304, or any complement thereof. Another interfering RNA molecule of the invention comprises a dsRNA which comprises, consist essentially of or consists of any 19-mer subsequence of SEQ ID NO: 305, wherein N is nucleotide 1 to nucleotide 786 of SEQ ID NO: 305, or any complement thereof. Another interfering RNA molecule of the invention comprises a dsRNA which comprises, consist essentially of or consists of any 19-mer subsequence of SEQ ID NO: 306, wherein N is nucleotide 1 to nucleotide 714 of SEQ ID NO: 306, or any complement thereof. Another interfering RNA molecule of the invention comprises a dsRNA which comprises, consist essentially of or consists of any 19-mer subsequence of SEQ ID NO: 307, wherein N is nucleotide 1 to nucleotide 648 of SEQ ID NO: 307, or any complement thereof. Another interfering RNA molecule of the invention comprises a dsRNA which comprises, consist essentially of or consists of any 19-mer subsequence of SEQ ID NO: 308, wherein N is nucleotide 1 to nucleotide 519 of SEQ ID NO: 308, or any complement thereof. Another interfering RNA molecule of the invention comprises a dsRNA which comprises, consist essentially of or consists of any 19-mer subsequence of SEQ ID NO: 309, wherein N is nucleotide 1 to nucleotide 531 of SEQ ID NO: 309, or any complement thereof. Another interfering RNA molecule of the invention comprises a dsRNA which comprises, consist essentially of or consists of any 19-mer subsequence of SEQ ID NO: 310, wherein N is nucleotide 1 to nucleotide 366 of SEQ ID NO: 310, or any complement thereof. Another interfering RNA molecule of the invention comprises a dsRNA which comprises, consist essentially of or consists of any 19-mer subsequence of SEQ ID NO: 311, wherein N is nucleotide 1 to nucleotide 1284 of SEQ ID NO: 311, or any complement thereof. Another interfering RNA molecule of the invention comprises a dsRNA which comprises, consist essentially of or consists of any 19-mer subsequence of SEQ ID NO: 312, wherein N is nucleotide 1 to nucleotide 426 of SEQ ID NO: 312, or any complement thereof. Another interfering RNA molecule of the invention comprises a dsRNA which comprises, consist essentially of or consists of any 19-mer subsequence of SEQ ID NO: 313, wherein N is nucleotide 1 to nucleotide 1680 of SEQ ID NO: 313, or any complement thereof. Another interfering RNA molecule of the invention comprises a dsRNA which comprises, consist essentially of or consists of any 19-mer subsequence of SEQ ID NO: 314, wherein N is nucleotide 1 to nucleotide 474 of SEQ ID NO: 314, or any complement thereof. Another interfering RNA molecule of the invention comprises a dsRNA which comprises, consist essentially of or consists of any 19-mer subsequence of SEQ ID NO: 315, wherein N is nucleotide 1 to nucleotide 5025 of SEQ ID NO: 315, or any complement thereof. Another interfering RNA molecule of the invention comprises a dsRNA which comprises, consist essentially of or consists of any 19-mer subsequence of SEQ ID NO: 316, wherein N is nucleotide 1 to nucleotide 453 of SEQ ID NO: 316, or any complement thereof. Another interfering RNA molecule of the invention comprises a dsRNA which comprises, consist essentially of or consists of any 19-mer subsequence of SEQ ID NO: 317, wherein N is nucleotide 1 to nucleotide 564 of SEQ ID NO: 317, or any complement thereof. Another interfering RNA molecule of the invention comprises a dsRNA which comprises, consist essentially of or consists of any 19-mer subsequence of SEQ ID NO: 318, wherein N is nucleotide 1 to nucleotide 816 of SEQ ID NO: 318, or any complement thereof. Another interfering RNA molecule of the invention comprises a dsRNA which comprises, consist essentially of or consists of any 19-mer subsequence of SEQ ID NO: 319, wherein N is nucleotide 1 to nucleotide 687 of SEQ ID NO: 319, or any complement thereof. Another interfering RNA molecule of the invention comprises a dsRNA which comprises, consist essentially of or consists of any 19-mer subsequence of SEQ ID NO: 320, wherein N is nucleotide 1 to nucleotide 846 of SEQ ID NO: 320, or any complement thereof. Another interfering RNA molecule of the invention comprises a dsRNA which comprises, consist essentially of or consists of any 19-mer subsequence of SEQ ID NO: 321, wherein N is nucleotide 1 to nucleotide 333 of SEQ ID NO: 321, or any complement thereof. Another interfering RNA molecule of the invention comprises a dsRNA which comprises, consist essentially of or consists of any 19-mer subsequence of SEQ ID NO: 322, wherein N is nucleotide 1 to nucleotide 882 of SEQ ID NO: 322, or any complement thereof. Another interfering RNA molecule of the invention comprises a dsRNA which comprises, consist essentially of or consists of any 19-mer subsequence of SEQ ID NO: 323, wherein N is nucleotide 1 to nucleotide 1299 of SEQ ID NO: 323, or any complement thereof. Another interfering RNA molecule of the invention comprises a dsRNA which comprises, consist essentially of or consists of any 19-mer subsequence of SEQ ID NO: 324, wherein N is nucleotide 1 to nucleotide 576 of SEQ ID NO: 324, or any complement thereof.

In still other embodiments, the interfering RNA molecule of the invention comprises a dsRNA which comprises, consists essentially of or consists of SEQ ID NO: 217-324, SEQ ID NO: 432-484, SEQ ID NO: 592-645, SEQ ID NO: 806-858, or the complement thereof.

In other embodiments of the interfering RNA molecule of the invention, the nucleotide sequence of the antisense strand of a dsRNA of the invention comprises, consists essentially of or consists of the complementary ribonucleic acid sequence of SEQ ID NO: 217-324, SEQ ID NO: 432-484, SEQ ID NO: 592-645, SEQ ID NO: 806-858. The nucleotide sequence of the antisense strand of a dsRNA of the invention can have one nucleotide at either the 3' or 5' end deleted or can have up to six nucleotides added at the 3' end, the 5' end or both, in any combination to achieve an antisense strand consisting essentially of any 19-mer, any 20-mer, or any 19-mer nucleotide sequence of the complementary ribonucleic acid sequence of SEQ ID NO: 217-324, SEQ ID NO: 432-484, SEQ ID NO: 592-645, SEQ ID NO: 806-858, as it would be understood that the deletion of the one nucleotide or the addition of up to the six nucleotides do not materially affect the basic characteristics or function of the double stranded RNA molecule of the invention. Such additional nucleotides can be nucleotides that extend the complementarity of the antisense strand along the target sequence and/or such nucleotides can be nucleotides that facilitate manipulation of the RNA molecule or a nucleic acid molecule encoding the RNA molecule, as would be known to one of ordinary skill in the art. For example, a TT overhang at the 3' end may be present, which is used to stabilize the siRNA duplex and does not affect the specificity of the siRNA.

In some embodiments of this invention, the antisense strand of the double stranded RNA of the interfering RNA molecule can be fully complementary to the target RNA polynucleotide or the antisense strand can be substantially complementary or partially complementary to the target RNA polynucleotide. The dsRNA of the interfering RNA molecule may comprise a dsRNA which is a region of double-stranded RNA comprising substantially complementary annealed strands, or which is a region of double-stranded RNA comprising fully complementary annealed strands. By substantially or partially complementary is meant that the antisense strand and the target RNA polynucleotide can be mismatched at about 1, 2, 3, 4, 5, 6, 7, 8, 9, or 10 nucleotide pairings. Such mismatches can be introduced into the antisense strand sequence, e.g., near the 3' end, to enhance processing of the double stranded RNA molecule by Dicer, to duplicate a pattern of mismatches in a siRNA molecule inserted into a chimeric nucleic acid molecule or artificial microRNA precursor molecule of this invention, and the like, as would be known to one of skill in the art. Such modification will weaken the base pairing at one end of the duplex and generate strand asymmetry, therefore enhancing the chance of the antisense strand, instead of the sense strand, being processed and silencing the intended gene (Geng and Ding "Double-mismatched siRNAs enhance selective gene silencing of a mutant ALS-causing Allele1" *Acta Pharmacol. Sin.* 29:211-216 (2008); Schwarz et al. "Asymmetry in the assembly of the RNAi enzyme complex" *Cell* 115:199-208 (2003)).

In some embodiments of this invention, the interfering RNA comprises a dsRNA which comprises a short hairpin RNA (shRNA) molecule. Expression of shRNA in cells is typically accomplished by delivery of plasmids or recombinant vectors, for example in transgenic plants such as transgenic soybean.

The invention encompasses a nucleic acid construct comprising an interfering RNA of the invention. The invention further encompasses a nucleic acid molecule encoding at least one interfering molecule of the invention. The invention further encompasses a nucleic acid construct comprising at least one interfering molecule of the invention or comprising a nucleic acid molecule encoding the at least one interfering molecule of the invention. The invention further encompasses a nucleic acid construct wherein the nucleic acid construct is an expression vector. The invention further encompasses a recombinant vector comprising a regulatory sequence operably linked to a nucleotide sequence that encodes an interfering RNA molecule of the invention. A regulatory sequence may refer to a promoter, enhancer, transcription factor binding site, insulator, silencer, or any other DNA element involved in the expression of a gene.

The invention further encompasses chimeric nucleic acid molecules comprising an interfering RNA molecule with an antisense strand of a dsRNA operably linked with a plant microRNA precursor molecule. In some embodiments, the chimeric nucleic acid molecule comprises an antisense strand having the nucleotide sequence of any of the 19-mer subsequences of SEQ ID NOs: 181-210, or any complement thereof, operably linked with a plant microRNA precursor molecule. In some embodiments, the plant microRNA precursor molecule is a maize microRNA precursor.

In some embodiments, the invention encompasses an artificial plant microRNA precursor molecule comprising an antisense strand of a dsRNA of an interfering RNA molecule of the invention. In other embodiments, the artificial plant microRNA precursor molecule comprises an antisense strand having the nucleotide sequence of any of the 19-mer, 20-mer, or 19-mer subsequences of the complementary ribonucleic acid sequence of SEQ ID NO: 217-324, SEQ ID NO: 432-484, SEQ ID NO: 592-645, SEQ ID NO: 806-858. The use of artificial plant microRNAs to deliver a nucleotide sequence of interest (e.g an artificial miRNA; siRNA/siRNA*) into a plant is known in the art (see, e.g., Schwab et al. 2006. The Plant Cell 18:1121-1133 and Examples section herein). In the invention, the artificial microRNAs are chimeric or hybrid molecules, having a plant microRNA precursor backbone and an insect siRNA sequence inserted therein. As would be understood by one of ordinary skill in the art, it is typically desirable to maintain mismatches that normally occur in the plant microRNA precursor sequence in any nucleotide sequence that is substituted into the plant microRNA precursor backbone. In still other embodiments, the artificial plant microRNA precursor comprises portions of a soybean microRNA precursor molecule. Any soybean microRNA (miRNA) precursor is suitable for the compositions and methods of the invention. Non-limiting examples of families of soybean microRNAs include miR159, miR169, miR395, miR156, miR159, miR160, miR171, miR398, miR408, miR828, miR4996, and miR5770 (Turner et al., 2012. *BMC Genomics* 13: 169; Tian et al., 2017. *BMC Genomics* 18: 572). Further non-limiting examples of soybean microRNAs can be found on the world wide web at the Soybean miRNA Functional Network website, also referred to as SoymiRNet, or at the Soybean Functional Network, also referred to as SoyFN.

In some embodiments, the invention encompasses interfering RNA molecules, nucleic acid constructs, nucleic acid molecules or recombinant vectors comprising at least one strand of a dsRNA of an interfering RNA molecule of the invention, or comprising a chimeric nucleic acid molecule of the invention, or comprising an artificial plant microRNA of the invention. In some embodiments the nucleic acid construct comprises a nucleic acid molecule of the invention. In other embodiments, the nucleic acid construct is a recombinant expression vector.

In some embodiments, the interfering RNA molecules of the invention have insecticidal activity on a stink bug. In some embodiments the stink bug is a member of the group comprising *Euschistus* spp. (for example *E. servus* (Brown Stink Bug), and *E. heros* (Neotropical Brown Stink Bug)), *Nezara* spp. (for example *N. antennata, N. hilare*, and *N. viridula* (Southern Green Stink Bug)), *Piezodorus* spp. (for example *P. guildinii* (Red-banded Stink Bug)), *Halyomorpha* spp. (for example *H. halys* (Brown Marmorated Stink Bug)), *Chinavia* spp. (for example *C. marginatum, C. hilare* (Green Stink Bug)), *Dichelops* spp. (for example *D. melacanthus, Dichelops furcatus*), *Edessa* spp. (for example *E. meditabunda*), *Thyanta* spp. (for example *T. perditor* (Neotropical Red Shouldered Stink Bug)), *Horcias* spp. (for example *H. nobilellus* (Cotton Bug)), *Taedia* spp. for example *T. stigmosa*), *Dysdercus* spp. (for example *D. peruvianus*), *Neomegalotomus* spp. (for example *N. parvus*), *Leptoglossus* spp. (for example *L. zonatus*), *Niesthrea* spp. (for example *N. sidae*), *Eurygaster* spp. (for example *E. intergriceps, E. maura*), *Oebalus* spp. (for example *O. mexicana, O. poecilus*, and *O. pugnase*) and *Scotinophara* spp. (for example *S. lurida, S. coarctata*). In some embodiments, the coding sequence of the target gene comprises a sequence selected from the group comprising SEQ ID NO: 1-54, SEQ ID NO: 163-216, SEQ ID NO: 379-431, SEQ ID NO: 538-591, and the complements thereof.

In some embodiments, the invention encompasses a composition comprising one or more or two or more of the interfering RNA molecules of the invention. In some embodiments, the interfering RNA molecules are present on the same nucleic acid construct, on different nucleic acid constructs, or any combination thereof. For example, one interfering RNA molecule of the invention may be present on a nucleic acid construct, and a second interfering RNA molecule of the invention may be present on the same nucleic acid construct or on a separate, second nucleic acid construct. The second interfering RNA molecule of the invention may be to the same target gene or to a different target gene. The second interfering RNA molecule may have the same sequences as the first interfering RNA molecule or may have a different sequence compared to the first interfering RNA molecule.

In some embodiments, the invention encompasses a composition comprising an interfering RNA molecule which comprises at least one dsRNA wherein the dsRNA is a region of double-stranded RNA comprising annealed complementary strands. One strand of the dsRNA comprises a sequence of at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 contiguous nucleotides which is at least partially complementary to a target nucleotide sequence within a stink bug spp target gene. The interfering RNA molecule (i) has at least 60% identity, at least 65% identity, at least 70% identity, at least 75% identity, at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of a nucleotide sequence encoding an amino acid sequence encoded by SEQ ID NO: 217-324, SEQ ID NO: 432-484, SEQ ID NO: 592-645, SEQ ID NO: 806-858, or the complement thereof.

In some embodiments, the invention encompasses compositions comprising an interfering RNA molecule comprising two or more dsRNAs, wherein the two or more dsRNAs each comprise a different antisense strand. In some embodiments the invention encompasses compositions comprising at least two more interfering RNA molecules, wherein the two or more interfering RNA molecules each comprise a dsRNA comprising a different antisense strand. The two or more interfering RNAs may be present on the same nucleic acid construct, on different nucleic acid constructs or any combination thereof. In other embodiments, the composition comprises a RNA molecule comprising an antisense strand consisting essentially of a nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858, and in some embodiments may further comprise an RNA molecule comprising an antisense strand consisting essentially of a second nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858; and in some embodiments may further comprise an RNA molecule comprising an antisense strand consisting essentially of a third nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858, and in some embodiments may further comprise an RNA molecule comprising an antisense strand consisting essentially of a fourth nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858, and in some embodiments may further comprise an RNA molecule comprising an antisense strand consisting essentially of a fifth nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858, and in some embodiments may further comprise an RNA molecule comprising an antisense strand consisting essentially of a sixth nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858, and in some embodiments may further comprise an RNA molecule comprising an antisense strand consisting essentially of a seventh nucleotide sequence comprising at least a 19 contiguous nucleotide fragment of the complementary ribonucleic acid sequence of SEQ ID NO: 217-324, SEQ ID NO: 432-484, SEQ ID NO: 592-645, SEQ ID NO: 806-858. In other embodiments, the composition may comprise two or more of the nucleic acid molecules, wherein the two or more nucleic acid molecules each encode a different interfering RNA molecule. In other embodiments, the composition may comprise two or more of the nucleic acid constructs, wherein the two or more nucleic acid constructs each comprise a nucleic acid molecule encoding a different interfering RNA.

In other embodiments, the composition comprises two or more nucleic acid constructs, two or more nucleic acid molecules, two or more chimeric nucleic acid molecules, two or more artificial plant microRNA precursors of the invention, wherein the two or more nucleic acid constructs, two or more nucleic acid molecules, two or more chimeric nucleic acid molecules, or two or more artificial plant microRNA precursors, each comprise a different antisense strand.

In some embodiments, the invention encompasses an insecticidal composition for inhibiting the expression of a stink bug gene described herein, comprising an interfering RNA of the invention and an agriculturally acceptable carrier. In some embodiments, the acceptable agricultural carrier is a transgenic organism expressing an interfering RNA of the invention. In some embodiments the transgenic organism may be a transgenic plant expressing the interfering RNA of the invention that when fed upon by a target hemipteran plant pest causes the target hemipteran plant pest to stop feeding, growing or reproducing or causing death of the target hemipteran plant pest. In other embodiments, the transgenic plant is a transgenic soybean plant and the target pest is a hemipteran or stink bug pest. In still other embodiments, the stink bug pest is selected from the group comprising *Euschistus* spp. (for example *E. servus* (Brown Stink Bug), and *E. heros* (Neotropical Brown Stink Bug)), *Nezara* spp. (for example *N. antennata, N. hilare*, and *N. viridula* (Southern Green Stink Bug)), *Piezodorus* spp. (for example *P. guildinii* (Red-banded Stink Bug)), *Halyomorpha* spp. (for example *H. halys* (Brown Marmorated Stink Bug)), *Chinavia* spp. (for example *C. marginatum, C. hilare* (Green Stink Bug)), *Dichelops* spp. (for example *D. melacanthus, Dichelops furcatus*), *Edessa* spp. (for example *E. meditabunda*), *Thyanta* spp. (for example *T. perditor* (Neotropical Red Shouldered Stink Bug)), *Horcias* spp. (for example *H. nobilellus* (Cotton Bug)), *Taedia* spp. for example *T. stigmosa*), *Dysdercus* spp. (for example *D. peruvianus*), *Neomegalotomus* spp. (for example *N. parvus*), *Leptoglossus* spp. (for example *L. zonatus*), *Niesthrea* spp. (for example *N. sidae*), *Eurygaster* spp. (for example *E. intergriceps, E. maura*), *Oebalus* spp. (for example *O. mexicana, O. poecilus*, and *O. pugnase*) and *Scotinophara* spp. (for example *S. lurida, S. coarctata*.

In other embodiments, the transgenic organism is selected from, but not limited to, the group consisting of: yeast, fungi, algae, bacteria, virus or an arthropod expressing the interfering RNA molecule of the invention. In some embodiments, the transgenic organism is a virus, for example an insect baculovirus that expresses an interfering RNA molecule of the invention upon infection of an insect host. Such a baculovirus is likely more virulent against the target insect than the wild-type untransformed baculovirus. In other embodiments the transgenic organism is a transgenic bacterium that is applied to an environment where a target pest occurs or is known to have occurred. In some embodiments, the transgenic bacterium is *Escherichia coli*. In some embodiments, non-pathogenic symbiotic bacteria, which are able to live and replicate within plant tissues, so-called endophytes, or non-pathogenic symbiotic bacteria, which are capable of colonizing the phyllosphere or the rhizosphere, so-called epiphytes, are used. Such bacteria include bacteria of the genera *Agrobacterium, Alcaligenes, Azospirillum, Azotobacter, Bacillus, Clavibacter, Enterobacter, Erwinia, Flavobacter, Klebsiella, Pseudomonas, Rhizobium, Serratia, Streptomyces* and *Xanthomonas*. Symbiotic fungi, such as *Trichoderma* and *Gliocladium* are also possible hosts for expression of the inventive interfering RNA molecule for the same purpose.

In some embodiments, an acceptable agricultural carrier is a formulation useful for applying the composition comprising the interfering RNA molecule to a plant or seed. In some embodiments, the interfering RNA molecules are stabilized against degradation because of their double stranded nature and the introduction of Dnase/Rnase inhibitors. For example, dsRNA or siRNA can be stabilized by including thymidine or uridine nucleotide 3' overhangs. The dsRNA or siRNA contained in the compositions of the invention can be chemically synthesized at industrial scale in large amounts. Methods available would be through chemical synthesis or through the use of a biological agent.

In other embodiments the formulation comprises a transfection promoting agent. In other embodiments, the transfection promoting agent is a lipid-containing compound. In further embodiments, the lipid-containing compound is selected from the group consisting of; Lipofectamine, Cellfectin, DMRIE-C, DOTAP and Lipofectin. In another embodiment, the lipid-containing compound is a Tris cationic lipid.

In some embodiments, the formulation further comprises a nucleic acid condensing agent. The nucleic acid condensing agent can be any such compound known in the art. Examples of nucleic acid condensing agents include, but are not limited to, spermidine (N-[3-aminopropyl]-1,4-butanediamine), protamine sulphate, poly-lysine as well as other positively charged peptides. In some embodiments, the nucleic acid condensing agent is spermidine or protamine sulfate.

In still further embodiments, the formulation further comprises buffered sucrose or phosphate buffered saline.

In some embodiments, the invention encompasses transgenic plants, or parts thereof, comprising an interfering RNA molecule, a nucleic acid construct, a chimeric nucleic acid molecule, an artificial plant microRNA precursor molecule and/or a composition of the invention, wherein the transgenic plant has enhanced resistance to a hemipteran insect or stink bug as compared to a control plant which does not comprise the molecule and/or composition of the invention. In other embodiments, the transgenic plant, or part thereof, is a transgenic soybean plant, or part thereof. The invention further encompasses transgenic seed of the transgenic plants of the invention, wherein the transgenic seed comprises an interfering RNA molecule, a nucleic acid construct, a chimeric nucleic acid molecule, an artificial plant microRNA precursor molecule and/or a composition of the invention. In some embodiments the transgenic seed is a transgenic soybean seed.

Transgenic plants expressing an interfering RNA of the invention are tolerant or resistant to attack by target insect pests. When the insect starts feeding on such a transgenic plant, it also ingests the expressed dsRNA or siRNA. This may deter the insect from further biting into the plant tissue or may even harm or kill the insect. A nucleic acid sequence encoding a dsRNA or siRNA of the invention is inserted into an expression cassette, which is then preferably stably integrated in the genome of the plant. The nucleic acid sequences of the expression cassette introduced into the genome of the plant are heterologous to the plant and non-naturally occurring. Plants transformed in accordance with the present invention may be monocots or dicots and include, but are not limited to, corn, soy, wheat, barley, rye, sweet potato, bean, pea, chicory, lettuce, cabbage, cauliflower, broccoli, turnip, radish, spinach, asparagus, onion, garlic, pepper, celery, squash, pumpkin, hemp, zucchini, apple, pear, quince, melon, plum, cherry, peach, nectarine, apricot, strawberry, grape, raspberry, blackberry, pineapple, avocado, papaya, mango, banana, soybean, tomato, sorghum, sugarcane, sugar beet, sunflower, rapeseed, clover, tobacco, carrot, cotton, alfalfa, rice, potato, eggplant, cucumber, Arabidopsis, and woody plants such as coniferous and deciduous trees. In further embodiments, the transgenic plant is a transgenic soybean plant.

Expression of the interfering RNA molecule in transgenic plants is driven by regulatory sequences comprising promoters that function in plants. The choice of promoter will vary depending on the temporal and spatial requirements for expression, and also depending on the insect target species. Thus, expression of the interfering RNAs of this invention in leaves, in stalks or stems, in inflorescences (e.g. flowers, pistil, stamen, and other flower parts), in seed pods, in seeds, in roots, and/or seedlings is contemplated. In many cases, however, protection against more than one type of insect pest is sought, and thus expression in multiple tissues is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of the dsRNA or siRNA in the desired cell.

Promoters useful with the invention include, but are not limited to, those that drive expression of a nucleotide sequence constitutively, those that drive expression when induced, and those that drive expression in a tissue- or developmentally-specific manner. These various types of promoters are known in the art.

Examples of constitutive promoters include, but are not limited to, cestrum virus promoter (cmp) (U.S. Pat. No. 7,166,770), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), figwort mosaic virus (FMV) promoter (Govindarajulu et al. 2008. *Mol Plant Microbe Interact* 21:1027-35) and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and Arabidopsis (Norris et al. 1993. *Plant Molec. Biol.* 21:895-906).

In some embodiments, tissue-specific/tissue-preferred promoters can be used. Tissue-specific or tissue-preferred expression patterns include, but are not limited to, green tissue specific or preferred, root specific or preferred, stem specific or preferred, and flower specific or preferred. Tissue-specific or tissue-preferential promoters useful for the expression of the nucleotide sequences of the invention in plants include but are not limited to those that direct expression in roots or particular cells in roots, pith, leaf or pollen. Such promoters are disclosed, for example without limitation, in WO 93/07278, herein incorporated by reference in its entirety. Other non-limiting examples of tissue specific or tissue preferred promoters useful with the invention include the stem specific promoter described in U.S. Pat. No. 5,625,136 (to Ciba-Geigy) and which drives expression of the maize trpA gene; and the cestrum yellow leaf curling virus promoter disclosed in WO 01/73087, all incorporated herein by reference.

In addition, promoters functional in plastids can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

In some embodiments of the invention, inducible promoters can be used. Thus, for example, chemical-regulated promoters can be used to modulate the expression of nucleotide sequences of the invention in a plant through the application of an exogenous chemical regulator. In further aspects, the nucleotide sequences of the invention can be operably associated with a promoter that is wound inducible or inducible by pest or pathogen infection (e.g., an insect or nematode plant pest).

In some embodiments of the present invention, a "minimal promoter" or "basal promoter" is used. A minimal promoter is capable of recruiting and binding RNA polymerase II complex and its accessory proteins to permit transcriptional initiation and elongation. In some embodiments, a minimal promoter is constructed to comprise only the nucleotides/nucleotide sequences from a selected promoter that are required for binding of the transcription factors and transcription of a nucleotide sequence of interest that is operably associated with the minimal promoter including but not limited to TATA box sequences. In other embodiments, the minimal promoter lacks cis sequences that recruit and bind transcription factors that modulate (e.g., enhance, repress, confer tissue specificity, confer inducibility or repressibility) transcription. A minimal promoter is generally placed upstream (i.e., 5') of a nucleotide sequence to be expressed. Thus, nucleotides/nucleotide sequences from any promoter useable with the present invention can be selected for use as a minimal promoter.

In some embodiments, a recombinant nucleic acid molecule of the invention can be an "expression cassette." As used herein, "expression cassette" means a recombinant nucleic acid molecule comprising a nucleotide sequence of interest (e.g., the nucleotide sequences of the invention), wherein the nucleotide sequence is operably associated with at least a control sequence (e.g., a promoter). Thus, some embodiments of the invention provide expression cassettes designed to express nucleotides sequences encoding the dsRNAs or siRNAs of the invention. In this manner, for example, one or more plant promoters operably associated with one or more nucleotide sequences of the invention are provided in expression cassettes for expression in a soybean plant, plant part and/or plant cell.

An expression cassette comprising a nucleotide sequence of interest may be chimeric, meaning that at least one of its components is heterologous with respect to at least one of its other components. An expression cassette may also be one that comprises a native promoter driving its native gene, however it has been obtained in a recombinant form useful for heterologous expression. Such usage of an expression cassette makes it so it is not naturally occurring in the cell into which it has been introduced.

An expression cassette also can optionally include a transcriptional and/or translational termination region (i.e., termination region) that is functional in plants. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the plant host, or may be derived from another source (i.e., foreign or heterologous to the promoter, the nucleotide sequence of interest, the plant host, or any combination thereof). Appropriate transcriptional terminators include, but are not limited to, the CAMV 35S terminator, the tml terminator, the nopaline synthase terminator and/or the pea rbcs E9 terminator. These can be used in both monocotyledons and dicotyledons. In addition, a coding sequence's native transcription terminator can be used.

An expression cassette of the invention also can include a nucleotide sequence for a selectable marker, which can be used to select a transformed plant, plant part and/or plant cell. As used herein, "selectable marker" means a nucleotide sequence that when expressed imparts a distinct phenotype to the plant, plant part and/or plant cell expressing the marker and thus allows such transformed plants, plant parts and/or plant cells to be distinguished from those that do not have the marker. Such a nucleotide sequence may encode either a selectable or screenable marker, depending on whether the marker confers a trait that can be selected for by chemical means, such as by using a selective agent (e.g., an antibiotic, herbicide, or the like), or on whether the marker is simply a trait that one can identify through observation or testing, such as by screening (e.g., the R-locus trait). Of course, many examples of suitable selectable markers are known in the art and can be used in the expression cassettes described herein.

Examples of selectable markers include, but are not limited to, a nucleotide sequence encoding neo or nptII, which confers resistance to kanamycin, G418, and the like (Potrykus et al. (1985) *Mol. Gen. Genet.* 199:183-188); a nucleotide sequence encoding bar, which confers resistance to phosphinothricin; a nucleotide sequence encoding an altered 5-enolpyruvylshikimate-3-phosphate (EPSP) synthase, which confers resistance to glyphosate (Hinchee et al. (1988) *Biotech.* 6:915-922); a nucleotide sequence encoding a nitrilase such as bxn from *Klebsiella ozaenae* that confers resistance to bromoxynil (Stalker et al. (1988) *Science* 242:419-423); a nucleotide sequence encoding an altered acetolactate synthase (ALS) that confers resistance to imidazolinone, sulfonylurea or other ALS-inhibiting chemicals (EP Patent Application No. 154204); a nucleotide sequence encoding a methotrexate-resistant dihydrofolate reductase (DHFR) (Thillet et al. (1988) *J. Biol. Chem.* 263:12500-12508); a nucleotide sequence encoding a dalapon dehalogenase that confers resistance to dalapon; a nucleotide sequence encoding a mannose-6-phosphate isomerase (also referred to as phosphomannose isomerase (PMI)) that confers an ability to metabolize mannose (U.S. Pat. Nos. 5,767,378 and 5,994,629); a nucleotide sequence encoding an altered anthranilate synthase that confers resistance to 5-methyl tryptophan; and/or a nucleotide sequence encoding hph that confers resistance to hygromycin. One of skill in the art is capable of choosing a suitable selectable marker for use in an expression cassette of the invention.

An expression cassette of the invention also can include polynucleotides that encode other desired traits. Such desired traits can be other polynucleotides which confer insect resistance, or which confer nematode resistance, or other agriculturally desirable traits. Such polynucleotides can be stacked with any combination of nucleotide sequences to create plants, plant parts or plant cells having the desired phenotype. Stacked combinations can be created by any method including, but not limited to, cross breeding plants by any conventional methodology, or by genetic transformation. If stacked by genetically transforming the plants, nucleotide sequences encoding additional desired traits can be combined at any time and in any order. For example, a single transgene can comprise multiple expression cassettes, such that multiple expression cassettes are introduced into the genome of a transformed cell at a single genomic location. Alternatively, a transgenic plant comprising one or more desired traits can be used as the target to introduce further traits by subsequent transformation. The additional nucleotide sequences can be introduced simultaneously in a co-transformation protocol with a nucleotide sequence, nucleic acid molecule, nucleic acid construct, and/or other composition of the invention, provided by any combination of expression cassettes. For example, if two nucleotide sequences will be introduced, they can be incorporated in separate cassettes (trans) or can be incorporated on the same cassette (cis). Expression of the nucleotide sequences can be driven by the same promoter or by different promoters. It is further recognized that nucleotide sequences can be stacked at a desired genomic location using a site-specific recombination system. See, e.g., Intl Patent Application Publication Nos. WO 99/25821; WO 99/25854; WO 99/25840; WO 99/25855 and WO 99/25853.

Thus, an expression cassette can include a coding sequence for one or more polypeptides for agronomic traits that primarily are of benefit to a seed company, grower or grain processor. A polypeptide of interest can be any polypeptide encoded by a polynucleotide sequence of interest. Non-limiting examples of polypeptides of interest that are suitable for production in plants include those resulting in agronomically important traits such as herbicide resistance (also sometimes referred to as "herbicide tolerance"), virus resistance, bacterial pathogen resistance, insect resistance, nematode resistance, and/or fungal resistance. See, e.g., U.S. Pat. Nos. 5,569,823; 5,304,730; 5,495,071; 6,329,504; and 6,337,431.

Vectors suitable for plant transformation are well known in the art. For Agrobacterium-mediated transformation, binary vectors or vectors carrying at least one T-DNA border sequence are suitable, whereas for direct gene transfer any vector is suitable and linear DNA containing only the construct of interest may be preferred. In the case of direct gene transfer, transformation with a single DNA species or co-transformation can be used (Schocher et al. Biotechnology 4:1093-1096 (1986)). For both direct gene transfer and *Agrobacterium*-mediated transfer, transformation is usually (but not necessarily) undertaken with a selectable marker that may provide resistance to an antibiotic (kanamycin, hygromycin or methotrexate) or a herbicide (basta). Plant transformation vectors of the invention may also comprise other selectable marker genes, for example, phosphomannose isomerase (PMI), which provides for positive selection of the transgenic plants as disclosed in U.S. Pat. Nos. 5,767,378 and 5,994,629, herein incorporated by reference, or phosphinotricin acetyltransferase (PAT), which provides tolerance to the herbicide phosphinotricin (glufosinate). The choice of selectable marker is not, however, critical to the invention.

In other embodiments, a nucleic acid sequence of the invention is directly transformed into the plastid genome. Plastid transformation technology is extensively described in U.S. Pat. Nos. 5,451,513, 5,545,817, and 5,545,818, in PCT application no. WO 95/16783, and in McBride et al. (1994) Proc. Natl. Acad. Sci. USA 91, 7301-7305. The basic technique for chloroplast transformation involves introducing regions of cloned plastid DNA flanking a selectable marker together with the gene of interest into a suitable target tissue, e.g., using biolistics or protoplast transformation (e.g., calcium chloride or PEG mediated transformation). The 1 to 1.5 kb flanking regions, termed targeting sequences, facilitate homologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab, Z., Hajdukiewicz, P., and Maliga, P. (1990) Proc. Natl. Acad. Sci. USA 87, 8526-8530; Staub, J. M., and Maliga, P. (1992) Plant Cell 4, 39-45). This resulted in stable homoplasmic transformants at a frequency of approximately one per 100 bombardments of target leaves. The presence of cloning sites between these markers allowed creation of a plastid targeting vector for introduction of foreign genes (Staub, J. M., and Maliga, P. (1993) EMBO J. 12, 601-606). Substantial increases in transformation frequency are obtained by replacement of the recessive rRNA or r-protein antibiotic resistance genes with a dominant selectable marker, the bacterial aadA gene encoding the spectinomycin-cletoxifying enzyme aminoglycoside-3'-adenyltransferase (Svab, Z., and Maliga, P. (1993) Proc. Natl. Acad. Sci. USA 90, 913-917). Previously, this marker had been used successfully for high-frequency transformation of the plastid genome of the green alga *Chlamydomonas reinhardtii* (Goldschmidt-Clermont, M. (1991) Nucl. Acids Res. 19:4083-4089). Other selectable markers useful for plastid transformation are known in the art and encompassed within the scope of the invention. Typically, approximately 15-20 cell division cycles following transformation are required to reach a homoplastidic state. Plastid expression, in which genes are inserted by homologous recombination into all of the several thousand copies of the circular plastid genome present in each plant cell, takes advantage of the enormous copy number advantage over nuclear-expressed genes to permit expression levels that can readily exceed 10% of the total soluble plant protein. In a preferred embodiment, a nucleic acid sequence of the present invention is inserted into a plastid-targeting vector and transformed into the plastid genome of a desired plant host. Plants homoplastic for plastid genomes containing a nucleic acid sequence of the present invention are obtained, and are preferentially capable of high expression of the nucleic acid sequence.

Transgenic plants or seed comprising an interfering RNA of the invention can also be treated with an insecticide or insecticidal seed coating, for example as described in U.S. Pat. Nos. 5,849,320, 5,876,739 and in U.S. Patent Application Publication US 2015/0164078A1, all of which are herein incorporated by reference. Where both the insecticide or insecticidal seed coating and the transgenic plant or seed of the invention are active against the same target insect, for example a hemipteran pest or a stink bug target pest, the combination is useful (i) in a method for further enhancing activity of the composition of the invention against the target insect, and (ii) in a method for preventing development of resistance to the composition of the invention by providing yet another mechanism of action against the target insect. Thus, the invention provides a method of enhancing control of a hemipteran or stink bug population comprising providing a transgenic plant or seed of the invention and applying to the plant or the seed an insecticide or insecticidal seed coating to a transgenic plant or seed of the invention. Examples of such insecticides and/or insecticidal seed coatings include, without limitation, a carbamate, a pyrethroid, an organophosphate, a friprole, a neonicotinoid, an organochloride, a nereistoxin, or a combination thereof. In another embodiment, the insecticide or insecticidal seed coating are selected from the group consisting of carbofuran, carbaryl, methomyl, bifenthrin, tefluthrin, permethrin, cyfluthrin, lambda-cyhalothrin, cypermethrin, deltamethrin, chlorpyrifos, chlorethoxyfos, dimethoate, ethoprophos, malathion, methyl-parathion, phorate, terbufos, tebupirimiphos, fipronil, acetamiprid, imidacloprid, thiacloprid, thiamethoxam, endosulfan, bensultap, and a combination thereof. Commercial products containing such insecticides and insecticidal seed coatings include, without limitation, Furadan® (carbofuran), Lanate® (methomyl, metomil, mesomile), Sevin® (carbaryl), Talstar® (bifenthrin), Force® (tefluthrin), Ammo® (cypermethrin), Cymbush® (cypermethrin), Delta Gold® (deltamethrin), Karate® (lambda-cyhalothrin), Ambush® (permethrin), Pounce® (permethrin), Brigade® (bifenthrin), Capture® (bifenthrin), ProShield® (tefluthrin), Warrior® (lambda-cyhalothrin), Dursban® (chlorphyrifos), Fortress® (chlorethoxyfos), Mocap® (ethoprop), Thimet® (phorate), AAstar® (phorate, flucythinate), Rampart® (phorate), Counter® (terbufos), Cygon® (dimethoate), Dicapthon, Regent® (fipronil), Cruiser® (thiamethoxam), Gaucho® (imidacloprid), Prescribe® (imidacloprid), Poncho® (clothianidin) and Aztec® (cyfluthrin, tebupirimphos).

The compositions of the invention can also be combined with other biological control agents to enhance control of a hemipteran insect or a stink bug populations, or to provide control against other insect pests. Thus, the invention provides a method of enhancing control of a hemipteran insect population or a stink bug population by providing a transgenic plant that produces an interfering RNA of the invention and further comprises a polynucleotide that encodes a second insecticidal agent. The second insecticidal agent may be an insecticidal protein derived from *Bacillus thuringiensis*. A *B. thuringiensis* insecticidal protein can be any of a number of insecticidal proteins including but not limited to a Cry1 protein, a Cry3 protein, a Cry7 protein, a Cry8 protein, a Cry11 protein, a Cry22 protein, a Cry23 protein, a Cry36 protein, a Cry37 protein, a Cry34 protein together with a Cry35 protein, a binary insecticidal protein CryET33 and CryET34, a binary insecticidal protein TIC100 and TIC101 (for example U.S. Pat. No. 7,655,838), a binary insecticidal protein PS14961, a VIP (for example U.S. Pat. No. 5,877,012), a TIC900 or related protein, a TIC901, TIC1201, TIC407, TIC417, a modified Cry1 protein, or hybrid proteins or chimeras made from any of the preceding insecticidal proteins. In other embodiments, the *B. thuringiensis* insecticidal protein is selected from the group consisting of Cry1Ac, Cry1A.105, Cry1F, and Cry2Ab2.

In other embodiments, the transgenic plant may produce an interfering RNA of the invention and a second insecticidal agent which is derived from sources other than *B. thuringiensis*. The second insecticidal agent can be an agent selected from the group comprising a patatin, a protease, a protease inhibitor, a chitinase, a urease, an alpha-amylase inhibitor, a pore-forming protein, a lectin, an engineered antibody or antibody fragment, a *Bacillus cereus* insecticidal protein, a *Xenorhabdus* spp. (such as *X. nematophila* or *X. bovienii*) insecticidal protein, a *Photorhabdus* spp. (such as *P. luminescens* or *P. asymobiotica*) insecticidal protein, a *Brevibacillus laterosporous* insecticidal protein, a *Lysinibacillus sphearicus* insecticidal protein, a *Chromobacterium* spp. insecticidal protein, a *Yersinia entomophaga* insecticidal protein, a *Paenibacillus popiliae* insecticidal protein, a *Clostridium* spp. (such as *C. bifermentans*) insecticidal protein, and a lignin. In other embodiments, the second agent may be at least one insecticidal protein derived from an insecticidal toxin complex (Tc) from *Photorhabdus, Xenorhabus, Serratia,* or *Yersinia*. In other embodiments the insecticidal protein may be an ADP-ribosyltransferase derived from an insecticidal bacteria, such as *Photorhabdus* spp. In other embodiments, the insecticidal protein may be a VIP protein, such as VIP1 or VIP2 from *B. cereus*. In still other embodiments, the insecticidal protein may be a binary toxin derived from an insecticidal bacteria, such as ISP1A and ISP2A from *B. laterosporous* or BinA and BinB from *L. sphaericus*. In still other embodiments, the insecticidal protein may be engineered or may be a hybrid or chimera of any of the preceding insecticidal proteins.

In another embodiment, the transgenic plant and transgenic seed is a soybean plant or soybean seed. In another embodiment, the transgenic soybean plant is provided by crossing a first transgenic soybean plant comprising a dsRNA of the invention with a transgenic soybean plant comprising a transgenic event, such as for example a YIELD GARD® soybean plant, a Roundup Ready® soybean plant, a Roundup Ready2 Xtend® soybean plant, a Liberty Link™ soybean plant, an Enlist™ soybean plant, a Treus™ soybean plant, a Plenish™ soybean plant, or a SYHT0H2 soybean plant.

Even where the insecticide or insecticidal seed coating is active against a different insect, the insecticide or insecticidal seed coating is useful to expand the range of insect control, for example by adding an insecticide or insecticidal seed coating that has activity against lepidopteran insects to the transgenic plant or seed of the invention, which has activity against hemipteran insects, the treated plant or coated transgenic seed controls both lepidopteran and hemipteran insect pests.

In further embodiments, the invention encompasses a biological sample from a transgenic plant, seed, or parts thereof, of the invention, wherein the sample comprises a nucleic acid that is or encodes at least one strand of a dsRNA of the invention. In other embodiments, the invention encompasses a commodity product derived from a transgenic plant, seed, or parts thereof, of the invention. In some embodiments, the commodity product is selected from the group consisting of whole or processed seeds, beans, grains, kernels, hulls, meals, grits, flours, sugars, sugars, starches, protein concentrates, protein isolates, waxes, oils, extracts, juices, concentrates, liquids, syrups, feed, silage, fiber, paper or other food or product produced from plants. In some embodiments, the commodity product consists of whole seeds and comprises a nucleic acid that is or encodes at least one strand of a dsRNA of the invention. In some embodiments, the biological sample or commodity product is toxic to insects. In some embodiments, the transgenic plant is a transgenic soybean plant.

The invention further encompasses a method of controlling a hemipteran insect or a stink bug comprising contacting the insect with a nucleic acid molecule that is or is capable of producing an interfering RNA molecule of the invention for inhibiting expression of a target gene in the insect thereby controlling the hemipteran insect or the stink bug. In some embodiments, the target gene comprises a coding sequence (i) having at least 60% identity, at least 65% identity, at least 70% identity, at least 75% identity, at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 1-54, SEQ ID NO: 163-216, SEQ ID NO: 379-431, SEQ ID NO: 538-591, or the complement thereof; or (ii) comprising at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 1-54, SEQ ID NO: 163-216, SEQ ID NO: 379-431, SEQ ID NO: 538-591, or the complement thereof; or (iii) comprising at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of a nucleotide sequence encoding an amino acid sequence encoded by SEQ ID NO: 1-54, SEQ ID NO: 163-216, SEQ ID NO: 379-431, SEQ ID NO: 538-591, or the complement thereof. In some embodiments the target gene coding sequence comprises SEQ ID NO: 1-54, SEQ ID NO: 163-216, SEQ ID NO: 379-431, SEQ ID NO: 538-591, or the complement thereof. In other embodiments, the interfering RNA molecule of the invention is complementary to a portion of a mRNA polynucleotide transcribable from the stink bug target genes described herein.

In some embodiments of the method of controlling a hemipteran insect pest or a stink bug pest, the interfering RNA molecule of the invention comprises at least one dsRNA, wherein the dsRNA is a region of double-stranded RNA comprising annealed complementary strands, one strand of which comprises a sequence of at least 19 contiguous nucleotides which (i) has at least 60% identity, at least 65% identity, at least 70% identity, at least 75% identity, at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of a nucleotide sequence encoding an amino acid sequence encoded by SEQ ID NO: 217-324, SEQ ID NO: 432-484, SEQ ID NO: 592-645, SEQ ID NO: 806-858, or the complement thereof.

In some embodiments of the method of controlling a hemipteran insect pest or a stink bug pest, the interfering RNA molecule comprises, consists essentially of or consists of from 18, 19, 20 or 21 consecutive nucleotides to at least about 300 consecutive of SEQ ID NO: 217-324, SEQ ID NO: 432-484, SEQ ID NO: 592-645, SEQ ID NO: 806-858, or a complement thereof. In other embodiments of the method, the interfering RNA of the invention comprises, consists essentially of or consists of any 19-mer subsequence of SEQ ID NO: 217-324, SEQ ID NO: 432-484, SEQ ID NO: 592-645, SEQ ID NO: 806-858 consisting of N to N+18 nucleotides, or any complement thereof. For example, an interfering RNA molecule of the invention comprises a dsRNA which comprises, consist essentially of or consists of any 19-mer subsequence of SEQ ID NO: 271, wherein N is nucleotide 1 to nucleotide 336 of SEQ ID NO: 271, or any complement thereof. In other words, the portion of the mRNA that is targeted comprises any of the 336 19-mers (a 19-mer refers to 19 consecutive nucleotides) subsequences of SEQ ID NO: 271, or any of their complementing sequences. It will be recognized that these 336 19-mer subsequences include all possible 19-mer subsequences from SEQ ID NO: 271 and from SEQ ID NO: 217, and their complements, as SEQ ID NOs 217 and 271 are to the same target, namely Nv_CG7622. It will similarly be recognized that all 19-mer subsequences of SEQ ID NO: 217-324, SEQ ID NO: 432-484, SEQ ID NO: 592-645, SEQ ID NO: 806-858, and all complement subsequences thereof, include all possible 19-mer subsequences of SEQ ID NO: 217-324, SEQ ID NO: 432-484, SEQ ID NO: 592-645, SEQ ID NO: 806-858, and the complement subsequences thereof.

Similarly, in some embodiments of the method of controlling a hemipteran pest or stink bug pest, the interfering RNA molecule comprises a dsRNA which comprises, consists essentially of or consists of any 19-mer subsequence of SEQ ID NO: 272, wherein N is nucleotide 1 to nucleotide 663 of SEQ ID NO: 272, or any complement thereof. Another interfering RNA molecule of the invention comprises a dsRNA which comprises, consist essentially of or consists of any 19-mer subsequence of SEQ ID NO: 273, wherein N is nucleotide 1 to nucleotide 357 of SEQ ID NO: 273, or any complement thereof. Another interfering RNA molecule of the invention comprises a dsRNA which comprises, consist essentially of or consists of any 19-mer subsequence of SEQ ID NO: 274, wherein N is nucleotide 1 to nucleotide 1275 of SEQ ID NO: 274, or any complement thereof. Another interfering RNA molecule of the invention comprises a dsRNA which comprises, consist essentially of or consists of any 19-mer subsequence of SEQ ID NO: 275, wherein N is nucleotide 1 to nucleotide 369 of SEQ ID NO: 275, or any complement thereof. Another interfering RNA molecule of the invention comprises a dsRNA which comprises, consist essentially of or consists of any 19-mer subsequence of SEQ ID NO: 276, wherein N is nucleotide 1 to nucleotide 1170 of SEQ ID NO: 276, or any complement thereof. Another interfering RNA molecule of the invention comprises a dsRNA which comprises, consist essentially of or consists of any 19-mer subsequence of SEQ ID NO: 277, wherein N is nucleotide 1 to nucleotide 1233 of SEQ ID NO: 277, or any complement thereof. Another interfering RNA molecule of the invention comprises a dsRNA which comprises, consist essentially of or consists of any 19-mer subsequence of SEQ ID NO: 278, wherein N is nucleotide 1 to nucleotide 462 of SEQ ID NO: 278, or any complement thereof. Another interfering RNA molecule of the invention comprises a dsRNA which comprises, consist essentially of or consists of any 19-mer subsequence of SEQ ID NO: 279, wherein N is nucleotide 1 to nucleotide 639 of SEQ ID NO: 279, or any complement thereof. Another interfering RNA molecule of the invention comprises a dsRNA which comprises, consist essentially of or consists of any 19-mer subsequence of SEQ ID NO: 280, wherein N is nucleotide 1 to nucleotide 672 of SEQ ID NO: 280, or any complement thereof. Another interfering RNA molecule of the invention comprises a dsRNA which comprises, consist essentially of or consists of any 19-mer subsequence of SEQ ID NO: 281, wherein N is nucleotide 1 to nucleotide 1113 of SEQ ID NO: 281, or any complement thereof. Another interfering RNA molecule of the invention comprises a dsRNA which comprises, consist essentially of or consists of any 19-mer subsequence of SEQ ID NO: 282, wherein N is nucleotide 1 to nucleotide 1113 of SEQ ID NO: 282, or any complement thereof. Another interfering RNA molecule of the invention comprises a dsRNA which comprises, consist essentially of or consists of any 19-mer subsequence of SEQ ID NO: 283, wherein N is nucleotide 1 to nucleotide 1500 of SEQ ID NO: 283, or any complement thereof. Another interfering RNA molecule of the invention comprises a dsRNA which comprises, consist essentially of or consists of any 19-mer subsequence of SEQ ID NO: 284, wherein N is nucleotide 1 to nucleotide 1251 of SEQ ID NO: 284, or any complement thereof. Another interfering RNA molecule of the invention comprises a dsRNA which comprises, consist essentially of or consists of any 19-mer subsequence of SEQ ID NO: 285, wherein N is nucleotide 1 to nucleotide 774 of SEQ ID NO: 285, or any complement thereof. Another interfering RNA molecule of the invention comprises a dsRNA which comprises, consist essentially of or consists of any 19-mer subsequence of SEQ ID NO: 286, wherein N is nucleotide 1 to nucleotide 2391 of SEQ ID NO: 286, or any complement thereof. Another interfering RNA molecule of the invention comprises a dsRNA which comprises, consist essentially of or consists of any 19-mer subsequence of SEQ ID NO: 287, wherein N is nucleotide 1 to nucleotide 2974 of SEQ ID NO: 287, or any complement thereof. Another interfering RNA molecule of the invention comprises a dsRNA which comprises, consist essentially of or consists of any 19-mer subsequence of SEQ ID NO: 288, wherein N is nucleotide 1 to nucleotide 432 of SEQ ID NO: 288, or any complement thereof. Another interfering RNA molecule of the invention comprises a dsRNA which comprises, consist essentially of or consists of any 19-mer subsequence of SEQ ID NO: 289, wherein N is nucleotide 1 to nucleotide 4587 of SEQ ID NO: 289, or any complement thereof. Another interfering RNA molecule of the invention comprises a dsRNA which comprises, consist essentially of or consists of any 19-mer subsequence of SEQ ID NO: 290, wherein N is nucleotide 1 to nucleotide 1089 of SEQ ID NO: 290, or any complement thereof. Another interfering RNA molecule of the invention comprises a dsRNA which comprises, consist essentially of or consists of any 19-mer subsequence of SEQ ID NO: 291, wherein N is nucleotide 1 to nucleotide 834 of SEQ ID NO: 291, or any complement thereof. Another interfering RNA molecule of the invention comprises a dsRNA which comprises, consist essentially of or consists of any 19-mer subsequence of SEQ ID NO: 292, wherein N is nucleotide 1 to nucleotide 771 of SEQ ID NO: 292, or any complement thereof. Another interfering RNA molecule of the invention comprises a dsRNA which comprises, consist essentially of or consists of any 19-mer subsequence of SEQ ID NO: 293, wherein N is nucleotide 1 to nucleotide 645 of SEQ ID NO: 293, or any complement thereof. Another interfering RNA molecule of the invention comprises a dsRNA which comprises, consist essentially of or consists of any 19-mer subsequence of SEQ ID NO: 294, wherein N is nucleotide 1 to nucleotide 696 of SEQ ID NO: 294, or any complement thereof. Another interfering RNA molecule of the invention comprises a dsRNA which comprises, consist essentially of or consists of any 19-mer subsequence of SEQ ID NO: 295, wherein N is nucleotide 1 to nucleotide 336 of SEQ ID NO: 295, or any complement thereof. Another interfering RNA molecule of the invention comprises a dsRNA which comprises, consist essentially of or consists of any 19-mer subsequence of SEQ ID NO: 296, wherein N is nucleotide 1 to nucleotide 639 of SEQ ID NO: 296, or any complement thereof. Another interfering RNA molecule of the invention comprises a dsRNA which comprises, consist essentially of or consists of any 19-mer subsequence of SEQ ID NO: 297, wherein N is nucleotide 1 to nucleotide 438 of SEQ ID NO: 297, or any complement thereof. Another interfering RNA molecule of the invention comprises a dsRNA which comprises, consist essentially of or consists of any 19-mer subsequence of SEQ ID NO: 298, wherein N is nucleotide 1 to nucleotide 1266 of SEQ ID NO: 298, or any complement thereof. Another interfering RNA molecule of the invention comprises a dsRNA which comprises, consist essentially of or consists of any 19-mer subsequence of SEQ ID NO: 299, wherein N is nucleotide 1 to nucleotide 597 of SEQ ID NO: 299, or any complement thereof. Another interfering RNA molecule of the invention comprises a dsRNA which comprises, consist essentially of or consists of any 19-mer subsequence of SEQ ID NO: 300, wherein N is nucleotide 1 to nucleotide 3525 of SEQ ID NO: 300, or any complement thereof. Another interfering RNA molecule of the invention comprises a dsRNA which comprises, consist essentially of or consists of any 19-mer subsequence of SEQ ID NO: 301, wherein N is nucleotide 1 to nucleotide 393 of SEQ ID NO: 301, or any complement thereof. Another interfering RNA molecule of the invention comprises a dsRNA which comprises, consist essentially of or consists of any 19-mer subsequence of SEQ ID NO: 302, wherein N is nucleotide 1 to nucleotide 492 of SEQ ID NO: 302, or any complement thereof. Another interfering RNA molecule of the invention comprises a dsRNA which comprises, consist essentially of or consists of any 19-mer subsequence of SEQ ID NO: 303, wherein N is nucleotide 1 to nucleotide 5856 of SEQ ID NO: 303, or any complement thereof. Another interfering RNA molecule of the invention comprises a dsRNA which comprises, consist essentially of or consists of any 19-mer subsequence of SEQ ID NO: 304, wherein N is nucleotide 1 to nucleotide 750 of SEQ ID NO: 304, or any complement thereof. Another interfering RNA molecule of the invention comprises a dsRNA which comprises, consist essentially of or consists of any 19-mer subsequence of SEQ ID NO: 305, wherein N is nucleotide 1 to nucleotide 786 of SEQ ID NO: 305, or any complement thereof. Another interfering RNA molecule of the invention comprises a dsRNA which comprises, consist essentially of or consists of any 19-mer subsequence of SEQ ID NO: 306, wherein N is nucleotide 1 to nucleotide 714 of SEQ ID NO: 306, or any complement thereof. Another interfering RNA molecule of the invention comprises a dsRNA which comprises, consist essentially of or consists of any 19-mer subsequence of SEQ ID NO: 307, wherein N is nucleotide 1 to nucleotide 648 of SEQ ID NO: 307, or any complement thereof. Another interfering RNA molecule of the invention comprises a dsRNA which comprises, consist essentially of or consists of any 19-mer subsequence of SEQ ID NO: 308, wherein N is nucleotide 1 to nucleotide 519 of SEQ ID NO: 308, or any complement thereof. Another interfering RNA molecule of the invention comprises a dsRNA which comprises, consist essentially of or consists of any 19-mer subsequence of SEQ ID NO: 309, wherein N is nucleotide 1 to nucleotide 531 of SEQ ID NO: 309, or any complement thereof. Another interfering RNA molecule of the invention comprises a dsRNA which comprises, consist essentially of or consists of any 19-mer subsequence of SEQ ID NO: 310, wherein N is nucleotide 1 to nucleotide 366 of SEQ ID NO: 310, or any complement thereof. Another interfering RNA molecule of the invention comprises a dsRNA which comprises, consist essentially of or consists of any 19-mer subsequence of SEQ ID NO: 311, wherein N is nucleotide 1 to nucleotide 1284 of SEQ ID NO: 311, or any complement thereof. Another interfering RNA molecule of the invention comprises a dsRNA which comprises, consist essentially of or consists of any 19-mer subsequence of SEQ ID NO: 312, wherein N is nucleotide 1 to nucleotide 426 of SEQ ID NO: 312, or any complement thereof. Another interfering RNA molecule of the invention comprises a dsRNA which comprises, consist essentially of or consists of any 19-mer subsequence of SEQ ID NO: 313, wherein N is nucleotide 1 to nucleotide 1680 of SEQ ID NO: 313, or any complement thereof. Another interfering RNA molecule of the invention comprises a dsRNA which comprises, consist essentially of or consists of any 19-mer subsequence of SEQ ID NO: 314, wherein N is nucleotide 1 to nucleotide 474 of SEQ ID NO: 314, or any complement thereof. Another interfering RNA molecule of the invention comprises a dsRNA which comprises, consist essentially of or consists of any 19-mer subsequence of SEQ ID NO: 315, wherein N is nucleotide 1 to nucleotide 5025 of SEQ ID NO: 315, or any complement thereof. Another interfering RNA molecule of the invention comprises a dsRNA which comprises, consist essentially of or consists of any 19-mer subsequence of SEQ ID NO: 316, wherein N is nucleotide 1 to nucleotide 453 of SEQ ID NO: 316, or any complement thereof. Another interfering RNA molecule of the invention comprises a dsRNA which comprises, consist essentially of or consists of any 19-mer subsequence of SEQ ID NO: 317, wherein N is nucleotide 1 to nucleotide 564 of SEQ ID NO: 317, or any complement thereof. Another interfering RNA molecule of the invention comprises a dsRNA which comprises, consist essentially of or consists of any 19-mer subsequence of SEQ ID NO: 318, wherein N is nucleotide 1 to nucleotide 816 of SEQ ID NO: 318, or any complement thereof. Another interfering RNA molecule of the invention comprises a dsRNA which comprises, consist essentially of or consists of any 19-mer subsequence of SEQ ID NO: 319, wherein N is nucleotide 1 to nucleotide 687 of SEQ ID NO: 319, or any complement thereof. Another interfering RNA molecule of the invention comprises a dsRNA which comprises, consist essentially of or consists of any 19-mer subsequence of SEQ ID NO: 320, wherein N is nucleotide 1 to nucleotide 846 of SEQ ID NO: 320, or any complement thereof. Another interfering RNA molecule of the invention comprises a dsRNA which comprises, consist essentially of or consists of any 19-mer subsequence of SEQ ID NO: 321, wherein N is nucleotide 1 to nucleotide 333 of SEQ ID NO: 321, or any complement thereof. Another interfering RNA molecule of the invention comprises a dsRNA which comprises, consist essentially of or consists of any 19-mer subsequence of SEQ ID NO: 322, wherein N is nucleotide 1 to nucleotide 882 of SEQ ID NO: 322, or any complement thereof. Another interfering RNA molecule of the invention comprises a dsRNA which comprises, consist essentially of or consists of any 19-mer subsequence of SEQ ID NO: 323, wherein N is nucleotide 1 to nucleotide 1299 of SEQ ID NO: 323, or any complement thereof. Another interfering RNA molecule of the invention comprises a dsRNA which comprises, consist essentially of or consists of any 19-mer subsequence of SEQ ID NO: 324, wherein N is nucleotide 1 to nucleotide 576 of SEQ ID NO: 324, or any complement thereof.

In some embodiments of the method of controlling a stink bug pest, the stink bug is a member of the group comprising *Euschistus* spp. (for example *E. servus, E. heros* (Fabr.) (Neotropical Brown Stink Bug)), *Nezara* spp. (for example *N. antennata, N. hilare, N. viridula* (L.) (Southern Green Stink Bug)), *Piezodorus guildinii* (Westwood) (Red-banded Stink Bug), *Halyomorpha halys* (Stal) (Brown Marmorated Stink Bug), *Chinavia hilare* (Say) (Green Stink Bug), *Euschistus servus* (Say) (Brown Stink Bug), *Dichelops melacanthus* (Dallas), *Dichelops furcatus* (F.), *Edessa meditabunda* (F.), *Thyanta perditor* (F.) (Neotropical Red Shouldered Stink Bug), *Chinavia marginatum* (Palisot de Beauvois), *Horcias nobilellus* (Berg) (Cotton Bug), *Taedia* stigmosa (Berg), *Dysdercus peruvianus* (Guerin-Meneville), *Neomegalotomus parvus* (Westwood), *Leptoglossus zonatus* (Dallas), *Niesthrea sidae* (F.), *Eurygaster* spp. (e.g. *Eurygaster intergriceps, Eurygaster maura*), *Oebalus* spp. (e.g. *Oebalus mexicana, Oebalus poecilus, Oebalus pugnase*, and *Scotinophara* spp. (e.g. *Scotinophara lurida, Scotinophara coarctata*.

In other embodiments of the method of controlling a hemipteran insect pest or a stink bug pest, the contacting comprises (a) planting a transgenic seed capable of producing a transgenic plant that expresses the nucleic acid molecule, wherein the insect feeds on the transgenic plant, or part thereof; or (b) applying a composition comprising the nucleic acid molecule to a seed or plant, or part thereof, wherein the insect feeds on the seed, the plant, or a part thereof. In some embodiments, the transgenic seed and the transgenic plant is a soybean seed or a soybean plant. In other embodiments the seed or plant is a soybean seed or a soybean plant.

The invention also encompasses a method of controlling a hemipteran or stink bug comprising contacting the hemipteran or stink bug with a nucleic acid molecule that is or is capable of producing the interfering RNA molecule of the invention for inhibiting expression of a target gene in the hemipteran or stink bug, and also contacting the hemipteran or stink bug with at least a second insecticidal agent for controlling hemipteran or stink bug, wherein said second insecticidal agent comprises a *B. thuringiensis* insecticidal protein, thereby controlling the hemipteran or stink bug. The invention also encompasses a method for controlling hemipteran or stink bug pests on a plant, comprising topically applying to said plant a pesticide composition comprising an interfering RNA of the invention and at least a second insecticidal agent for controlling a hemipteran or stink bug, wherein said second insecticidal agent does not comprise a *B. thuringiensis* insecticidal protein, and providing said plant in the diet of said hemipteran or stink bug. The invention also encompasses a method wherein the second insecticidal agent comprises a patatin, a protease, a protease inhibitor, a urease, an alpha-amylase inhibitor, a pore-forming protein, a lectin, an engineered antibody or antibody fragment, or a chitinase. The second insecticidal agent may also be a *Bacillus cereus* insecticidal protein, a *Xenorhabdus* spp. insecticidal protein, a *Photorhabdus* spp. insecticidal protein, a *Brevibacillus laterosporous* insecticidal protein, a *Lysinibacillus sphearicus* insecticidal protein, a *Chromobacterium* ssp. insecticidal protein, a *Yersinia entomophaga* insecticidal protein, a *Paenibacillus popiliae* insecticidal protein, or a *Clostridium* spp. insecticidal protein.

The invention also encompasses a method of reducing an hemipteran insect population or an stink bug population on a transgenic plant expressing a Cry protein, a hybrid Cry protein or modified Cry protein comprising expressing in the transgenic plant a nucleic acid molecule that is or is capable of producing an interfering RNA molecule of the invention capable of inhibiting expression of a target gene as described herein in an insect, thereby reducing the hemipteran insect population or stink bug population.

In some embodiments, the invention encompasses a method of reducing the level of a target mRNA transcribable from a target gene as described herein in a hemipteran insect or a stink bug comprising contacting the insect with a composition comprising the interfering RNA molecule of the invention, wherein the interfering RNA molecule reduces the level of the target mRNA in a cell of the insect. In some embodiments, the interfering RNA of the method comprises at least one dsRNA, wherein the dsRNA is a region of double-stranded RNA comprising annealed complementary strands, one strand of which comprises a sequence of at least 19 contiguous nucleotides which (i) has at least 60% identity, at least 65% identity, at least 70% identity, at least 75% identity, at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of SEQ ID NO: 217-324, SEQ ID NO: 432-484, SEQ ID NO: 592-645, SEQ ID NO: 806-858, or the complement thereof; or (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 contiguous nucleotide fragment of a nucleotide sequence encoding an amino acid sequence encoded by SEQ ID NO: 217-324, SEQ ID NO: 432-484, SEQ ID NO: 592-645, SEQ ID NO: 806-858, or the complement thereof, wherein the interfering RNA molecule has insecticidal activity against the target hemipteran insect or a stink bug. In another embodiment, the contacting is achieved by the target insect feeding on the composition. In other embodiments, production of the protein encoded by the target mRNA is reduced. In other embodiments, the target protein comprises an amino acid having at least about 80%, at least about 85%, at least about 90%, at least about 91%, at least about 92%, at least about 93%, at least about 94%, at least about 95%, at least about 96%, at least about 97%, at least about 98% or at least about 99% identity to SEQ ID NO: 325-378, SEQ ID NO: 485-537, or SEQ ID NO: 646-699. In other embodiments the target protein comprises SEQ ID NO:241-270. In other embodiments, the interfering RNA is contacted with a hemipteran insect or a stink bug through a transgenic organism expressing the interfering RNA. In other embodiments, the transgenic organism is a transgenic plant, a transgenic microorganism, a transgenic bacterium or a transgenic endophyte. In other embodiments, the interfering RNA is contacted with a hemipteran insect or a stink bug by topically applying an interfering RNA in an acceptable agricultural carrier to a plant or plant part on which the insect feeds. In some embodiments, the interfering RNA that reduces the level of a target mRNA transcribable from a target gene described herein is lethal to the hemipteran insect or stink bug. In some embodiments, the stink bug is a member of the group comprising *Euschistus* spp. (for example *E. servus, E. heros* (Fabr.) (Neotropical Brown Stink Bug)), *Nezara* spp. (for example *N. antennata, N. hilare, N. viridula* (L.) (Southern Green Stink Bug)), *Piezodorus guildinii* (Westwood) (Red-banded Stink Bug), *Halyomorpha halys* (Stal) (Brown Marmorated Stink Bug), *Chinavia hilare* (Say) (Green Stink Bug), *Euschistus servus* (Say) (Brown Stink Bug), *Dichelops melacanthus* (Dallas), *Dichelops furcatus* (F.), *Edessa meditabunda* (F.), *Thyanta perditor* (F.) (Neotropical Red Shouldered Stink Bug), *Chinavia marginatum* (Palisot de Beauvois), *Horcias nobilellus* (Berg) (Cotton Bug), *Taedia stigmosa* (Berg), *Dysdercus peruvianus* (Guerin-Meneville), *Neomegalotomus parvus* (Westwood), *Leptoglossus zonatus* (Dallas), *Niesthrea sidae* (F.), *Eurygaster* spp. (e.g. *Eurygaster intergriceps, Eurygaster maura*), *Oebalus* spp. (e.g. *Oebalus mexicana, Oebalus poecilus, Oebalus pugnase*, and *Scotinophara* spp. (e.g. *Scotinophara lurida, Scotinophara coarctata*).

In some embodiments, the invention encompasses a method of conferring hemipteran insect tolerance or stink bug tolerance to a plant, or part thereof, comprising introducing into the plant, or part thereof, an interfering RNA molecule, a dsRNA molecule, a nucleic acid construct, a chimeric nucleic acid molecule, an artificial plant microRNA precursor molecule and/or a composition of the invention, wherein the dsRNA molecule, nucleic acid construct, chimeric nucleic acid molecule, artificial plant microRNA precursor molecule and/or composition of the invention are toxic to the insect, thereby conferring tolerance of the plant or part thereof to the hemipteran insect or stink bug. In other embodiments, the introducing step is performed by transforming a plant cell and producing the transgenic plant from the transformed plant cell. In still other embodiments, the introducing step is performed by breeding two plants together.

In other embodiments, the invention encompasses a method of reducing plant damage to a plant fed upon by a hemipteran or stink bug, comprising introducing into cells of the plant an interfering RNA molecule, a dsRNA, a nucleic acid molecule, a nucleic acid construct, a chimeric nucleic acid molecule, an artificial plant microRNA precursor molecule and/or a composition of the invention, wherein the dsRNA, nucleic acid molecule, nucleic acid construct, chimeric nucleic acid molecule, artificial plant microRNA precursor molecule and/or composition of the invention are toxic to the hemipteran or stink bug, thereby reducing plant damage to the plant. In other embodiments, the introducing step is performed by transforming a plant cell and producing the transgenic plant from the transformed plant cell. In still other embodiments, the introducing step is performed by breeding two plants together.

In still other embodiments, the invention encompasses a method of producing a transgenic plant cell having toxicity to a hemipteran insect or stink bug, comprising introducing into a plant cell an interfering RNA molecule, a dsRNA, a nucleic acid molecule, a nucleic acid construct, a chimeric nucleic acid molecule, an artificial plant microRNA precursor molecule and/or a composition of the invention, thereby producing the transgenic plant cell having toxicity to the insect compared to a control plant cell. In some embodiments, the invention encompasses a plurality of transgenic plant cells produced by this method. In other embodiments, the plurality of transgenic plant cells is grown under conditions which include natural sunlight. In other embodiments, the introducing step is performed by transforming a plant cell and producing the transgenic plant from the transformed plant cell. In still other embodiments, the introducing step is performed by breeding two plants together.

In some embodiments, the invention encompasses a method of producing a transgenic plant having enhanced tolerance to hemipteran or stink bug feeding damage, comprising introducing into a plant an interfering RNA molecule, a dsRNA, a nucleic acid molecule, a nucleic acid construct, a chimeric nucleic acid molecule, an artificial plant microRNA precursor molecule and/or a composition of the invention, thereby producing a transgenic plant having enhanced tolerance to hemipteran or stink bug feeding damage compared to a control plant. In other embodiments, the introducing step is performed by transforming a plant cell and producing the transgenic plant from the transformed plant cell. In still other embodiments, the introducing step is performed by breeding two plants together.

In some embodiments, the invention encompasses a method of providing a soybean grower with a means of controlling a hemipteran insect pest population or a stink bug pest population in a soybean crop comprising (a) selling or providing to the grower transgenic soybean seed that comprises an interfering RNA, a nucleic acid molecule, a nucleic acid construct, a chimeric nucleic acid molecule, an artificial plant microRNA precursor molecule and/or a composition of the invention; and (b) advertising to the grower that the transgenic soybean seed produce transgenic soybean plants that control a hemipteran or stink bug pest population.

In some embodiments, the invention encompasses a method of identifying a target gene for using as a RNAi strategy for the control of a plant pest for RNAi in a hemipteran plant pest, said method comprising the steps of a) producing a primer pair with sequences selected from the group comprising or consisting of SEQ ID NO: 55-162, 700-805; b) amplifying an orthologous target from a nucleic acid sample of the plant pest; c) identifying a sequence of an orthologous target gene; d) producing an interfering RNA molecule, wherein the RNA comprises at least one dsRNA, wherein the dsRNA is a region of double-stranded RNA comprising annealed complementary strands, one strand of which comprises a sequence of at least 19 contiguous nucleotides which is at least partially complementary to a target nucleotide sequence within a hemipteran target gene, is obtained; and e) determining if the interfering RNA molecule has insecticidal activity on the plant pest. If the interfering RNA has insecticidal activity on the hemipteran pest, a target gene for using in the control of the plant pest has been identified. In some embodiments, the plant pest is a hemipteran plant pest.

EXAMPLES

The invention will be further described by reference to the following detailed examples. These examples are provided for the purposes of illustration only, and are not intended to be limiting unless otherwise specified.

Example 1

Stink Bug Putative Target Identification

Total RNA was isolated from mixed instars of southern green stink bugs that were field collected from the United States and kept in colony. Messenger RNA was isolated and a 100 bp paired-end library was prepared and sequenced according to the manufacturer's protocols on an Illumina HiSeq2000. Reads were assembled using Trinity with default settings. Open reading frames (ORFS) were predicted using Transdecoder using default parameters. The resulting ORFS were used in downstream analyses and lethal gene prediction.

Lethal genes from *Drosophila melanogaster* such as genes linked to cell viability (Boutros et al. 2004), lethal alleles, lethal insertions and *Caenorhabditis elegans* RNAi-lethal genes were compared by tblastn to the southern green stink bug ORFS to identify the best matching transcript for each entry in the lethal gene set. The ORF with the best blast match (lowest e-value, then highest bitscore) was kept as the putative ortholog, resulting in 2924 unique sequences. Of that list 144 southern green stink bug ORFS had matches to a Drosophila ortholog that was a lethal allele, lethal insertion, and linked to cell viability in the cell-based screen. Next, 30 previously qualified western corn rootworm, *Diabrotica virgifera virgifera*, target genes were compared by tblastx to the southern green stink bug ORFS, and 29 orthologs were identified. A separate list of 231 lethal target genes from multiple species was compared via tblastn to the southern green stink bug ORFS and 109 sequences were chosen. A final list of 249 southern green stink bug ORFS were selected for primer design and dsRNA synthesis.

Double-stranded RNAs of the 249 targets were produced in a 96 well plate format, one target per well, with appropriate positive and negative controls. Primers were designed with Primer3 software to amplify a 700-800 bp fragment; for sequences less than this length, primers were designed to amplify a region as large as possible. T7 promoters were added to the 5' end of each primer so that resulting DNA templates could be immediately used in in vitro transcription reactions. The mean dsRNA length was 649 bp long and ranged from 183 to 799 bp. Templates were synthesized by PCR on cDNA prepared from *N. viridula* at different life stages. The quality of the template material was analyzed by gel electrophoresis and spectrophotometry. Following dsRNA synthesis by in vitro T7 transcription, the dsRNA was purified, the amounts of dsRNA per target were normalized, and a final quality check of the dsRNA was performed by gel electrophoresis and spectrophotometry.

Example 2

Identification of dsRNAs that are Insecticidal on Stink Bugs

Identification of dsRNAs from *N. viridula* that are Insecticidal in *E. heros*

A variety of native sequences in hemipteran pests may be used as target sequences for the design of nucleic acid molecules of the invention, such as dsRNAs, interfering RNAs, and DNA molecules encoding interfering RNAs. Selection of native sequences is not, however, a straight-forward process. Only a small number of native sequences in the hemipteran pest will be effective targets. For example, it cannot be predicted with certainty whether a particular native sequence can be effectively down-regulated by nucleic acid molecules of the invention, or whether down-regulation of a particular native sequence will have a detrimental effect on the growth, viability, proliferation, and/or reproduction of the hemipteran pest. It is known in the art that the vast majority of native insect plant pest sequences, such as ESTs isolated therefrom (for example, as listed in U.S. Pat. Nos. 7,612,194 and 7,943,819), do not have a detrimental effect on the growth, viability, proliferation, and/or reproduction of the insect pest (See Baum et al., 2007; also see Narva et al, U.S. Patent Publication US2012/0174260A1). Therefore, the dsRNA molecules described above were tested for their potential to elicit a lethal RNAi response against second instar nymphs of *Euschistus heros* and *Nezara viridula* in laboratory bioassays.

In vitro assays on stink bug nymphs were performed in 96-well nylon mesh filter plates. Each well of a 96-well filter plate housed a second instar nymph exposed to a parafilm sachet containing a mixture of 15% sucrose and 1 µg/µl dsRNA. Plates were stored in plastic boxes in a rearing chamber at 26° C., 65% RH, and 16:8 hours light:dark. Survival was recorded from 3 to 10 days post exposure to dsRNA. dsRNA of non target GFP was used as a negative control. A positive control dsRNA target known to be lethal was also included in the assays. dsRNA molecules to the 249 targets described above were tested. Surprisingly, despite extensive pre-selection, only 54 of these targets induced a significantly high level of mortality (>30% mortality above the negative control) 6-10 days post infestation compared to the negative control. Results are shown in Table 1. Percent mortality above the negative control (Abbot corrected; Abbott, 1925, J. Econ. Entomology 18: 265-267) at 10 days post-exposure are shown. The Flybase ID (found at the flybase.org website), which is based on the putative orthologous *D. melanogaster* gene, is also shown with the corresponding putative gene name or function.

Table 1 also shows the percent identity of the *N. viridula* target gene to the orthologous gene from other stink bug species, namely *E. heros, Piezodorus guildinii, Dichelops melacanthus*, and *Halyomorpha halys*. The nucleic acid sequences for the *E. heros, D. melacanthus*, and *H. halys* orthologs were identified using sequences deposited in publicly available NCBI databases. (Farias et al., 2015. *PLOS One, DOI:* 10.1371/journal.pone.0132286; Fishilevich et al., 2016. *Insect Biochemistry and Molecular Biology*, 71: 58-71; Sparks et al., 2014. *PLOS One*, 9(11): e111646; SRA Database, ID No. SRR5651513). The nucleic acids sequences for the *P. guildinii* orthologs were determined using a transcriptome generated from a mixture of each instar and adult *P. guildinii* stink bugs.

TABLE 1 dsRNAs derived from *N. viridula* targets insecticidal against *E. heros*

| SEQ ID NO | Target ID | flybase ID | flybase symbol | % mortality | % Eh | Identity compared to: Pg | Dm | Hh |
|---|---|---|---|---|---|---|---|---|
| 1 | Nv_CG7622 | CG7622 | RpL36 | 49 | 90.68 | 90.96 | NA | 90.96 |
| 2 | Nv_CG1088 | CG1088 | Vha26 | 41 | 90.31 | 92.36 | 92.31 | 91.92 |

TABLE 1-continued dsRNAs derived from *N. viridula* targets insecticidal against *E. heros*

| SEQ ID NO | Target ID | flybase ID | flybase symbol | % mortality | % Eh | Identity compared to: Pg | Dm | Hh |
|---|---|---|---|---|---|---|---|---|
| 3 | Nv_CG6213 | CG6213 | Vha13 | 56 | 90.43 | 93 | 91.67 | 93.84 |
| 4 | Nv_CG10370 | CG10370 | Rpt5 | 38 | 89.21 | 91.87 | 90.1 | 89.46 |
| 5 | Nv_CG2960 | CG2960 | RpL40 | 41 | 64.83 | 92.76 | 81.94 | 91.73 |
| 6 | Nv_CG3455 | CG3455 | Rpt4 | 58 | 90.31 | 90.82 | 79.82 | 93.01 |
| 7 | Nv_CG10149 | CG10149 | Rpn6 | 55 | 89.15 | 89.08 | 90.28 | 90.5 |
| 8 | Nv_CG12775 | CG12775 | RpL21 | 77 | 90.42 | 92.5 | 85.84 | 93.75 |
| 9 | Nv_CG2746 | CG2746 | RpL19 | 46 | 92.51 | 92.17 | 90.83 | 92.09 |
| 10 | Nv_CG17420 | CG17420 | RpL15 | 73 | 89.25 | 88.12 | 89.61 | 90.86 |
| 11 | Nv_CG4027 | CG4027 | Act5C | 56 | 92.48 | 81.87 | 83.43 | 94.08 |
| 12 | Nv_CG5178 | CG5178 | Act88F | 55 | 97.97 | 97.52 | 96.64 | 97.44 |
| 13 | Nv_CG14813 | CG14813 | deltaCOP | 58 | 91.39 | 92.29 | NA | 92.49 |
| 14 | Nv_CG9075 | CG9075 | elF-4a | 41 | 93.95 | 93.6 | 94.93 | 94.64 |
| 15 | Nv_CG11276 | CG11276 | RpS4 | 58 | 88.01 | 89.14 | 88.52 | 89.65 |
| 16 | Nv_CG2331 | CG2331 | TER94 | 85 | 92.59 | 92.86 | 59.32 | 94.02 |
| 17 | Nv_CG11271 | CG11271 | RpS12 | 50 | 92.1 | 90.05 | 90.34 | 92.35 |
| 18 | Nv_CG33859 | CG33859 | His2A: CG33859 | 53 | 93.26 | 94.4 | 92.53 | 93.6 |
| 19 | Nv_CG3722 | CG3722 | shg | 46 | 80.65 | 90.59 | NA | 91.82 |
| 20 | Nv_CG7107 | CG7107 | up | 50 | 95.88 | 95.18 | 94.92 | 96.05 |
| 21 | Nv_CG4898 | CG4898 | Tm1 | 36 | 95.18 | 95.54 | 72.96 | 95.66 |
| 22 | Nv_CG2168 | CG2168 | RpS3A | 66 | 91.76 | 91.63 | 91.92 | 88.47 |
| 23 | Nv_CG17521 | CG17521 | RpL10 | 36 | 92.91 | 92.91 | 93.69 | 93.97 |
| 24 | Nv_CG6779 | CG6779 | RpS3 | 56 | 87.54 | 86.16 | 86.94 | 84.59 |
| 25 | Nv_CG4087 | CG4087 | RpLP1 | 50 | NA | 93.5 | 79.48 | 82.3 |
| 26 | Nv_CG8055 | CG8055 | shrb | 64 | 89.95 | 92.69 | 91.67 | 92.69 |
| 27 | Nv_CG13389 | CG13389 | RpS13 | 78 | 87.2 | 90.13 | 86.65 | 89.25 |
| 28 | Nv_CG5502 | CG5502 | RpL4 | 55 | 89.39 | 90.61 | 89.58 | 91.86 |
| 29 | Nv_CG1475 | CG1475 | RpL13A | 42 | 90.22 | 92.03 | 89.63 | 91.71 |
| 30 | Nv_CG13109 | CG13109 | tai | 31 | 80.11 | 86.22 | NA | 82.61 |
| 31 | Nv_CG4759 | CG4759 | RpL27 | 42 | 89.78 | 91.73 | 92.62 | 92.46 |
| 32 | Nv_CG7726 | CG7726 | RpL11 | 36 | 77.89 | 79.88 | 78.88 | 78.29 |
| 33 | Nv_CG17927 | CG17927 | Mhc | 64 | 94.29 | 94.58 | 95.09 | 95.45 |
| 34 | Nv_CG1519 | CG1519 | Prosalpha 7 | 51 | 89.73 | 89.45 | 70.27 | 90.62 |
| 35 | Nv_CG11522 | CG11522 | RpL6 | 73 | 86.9 | 88.09 | 84.37 | 89.05 |
| 36 | Nv_CG8186 | CG8186 | Vha36-1 | 31 | 87.95 | 90.83 | 84.7 | 92.89 |
| 37 | Nv_CG4651 | CG4651 | RpL13 | 63 | 86.06 | 87.84 | 87.56 | 87.84 |
| 38 | Nv_CG3948 | CG3948 | zetaCOP | 100 | 91.62 | 91.62 | NA | 91.06 |
| 39 | Nv_CG8385 | CG8385 | Arf79F | 83 | 97.39 | 93.44 | NA | 94.9 |
| 40 | Nv_CG3949 | CG3949 | hoip | 57 | NA | 89.58 | NA | 94.01 |
| 41 | Nv_CG1341 | CG1341 | Rpt1 | 54 | 90.85 | 91.78 | 82.9 | 89.83 |
| 42 | Nv_CG6846 | CG6846 | RpL26 | 63 | 80.86 | 92.57 | 80.54 | 91.22 |
| 43 | Nv_CG6223 | CG6223 | betaCOP | 74 | NA | 93.69 | NA | 94.29 |
| 44 | Nv_CG6253 | CG6253 | RpL14 | 88 | 85.71 | 86.17 | 86.82 | 85.45 |
| 45 | Nv_CG9012 | CG9012 | Chc | 74 | 90.96 | 92.56 | 73.96 | 94.29 |
| 46 | Nv_CG5271 | CG5271 | RpS27A | 70 | 89.6 | 92.99 | 91.95 | 91.3 |
| 47 | Nv_CG3395 | CG3395 | RpS9 | 32 | 91.53 | 89.52 | 90.55 | 91.58 |
| 48 | Nv_CG3329 | CG3329 | Prosbeta2 | 57 | 88.6 | 88.01 | NA | 89.81 |
| 49 | Nv_CG5266 | CG5266 | Prosalpha2 | 61 | 91.35 | 90.78 | NA | 91.49 |
| 50 | Nv_CG7434 | CG7434 | RpL22 | 57 | 91.18 | 89.36 | 88.74 | 90.33 |
| 51 | Nv_CG10305 | CG10305 | RpS26 | 51 | 91.45 | 91.45 | NA | 92.31 |
| 52 | Nv_CG17489 | CG17489 | RpL5 | 63 | 90.67 | 90.33 | 89.9 | 92.22 |
| 53 | Nv_CG32744 | CG32744 | Ubi-5pE | 84 | 63.9 | 82.24 | 79.47 | 82.5 |
| 54 | Nv_CG7178 | CG7178 | troponin | 82 | 93.23 | 89.01 | NA | 94.77 |

The data in Table 1 indicate that dsRNA molecules against a target gene in one genus of stink bug (*Nezara viridula*) have insecticidal activity against a different genus of stink bug (*Euschistus heros*). This is true despite the percent identity between the target gene from *N. viridula* and *E. heros* being as low as 63.9%. Therefore, this example illustrates that a percent identity as low as 63.9% between the target gene and the dsRNA molecule is sufficient for an insecticidal effect in a stink bug species. The best performing 33 targets were selected for further study.

Targets Insecticidal to More than One Genus of Stink Bug

Of the 33 targets confirmed to be significantly insecticidal, 16 were subsequently assayed for insecticidal activity on *N. viridula*. Positive and negative controls were also assayed using bioassay methods similar to Example 2, except *N. viridula* nymphs were used. Percent mortality was determined on day 14 and was Abbot corrected compared to the negative control. Results are shown in Table 2.

TABLE 2

Targets with insecticidal activity on *N. viridula*

| Target ID | % mortality |
|---|---|
| Nv_CG3948 | 94.5% |
| Nv_CG32744 | 61.5% |
| Nv_CG6213 | 84.7% |
| Nv_CG14813 | 80.3% |
| Nv_CG2746 | 80.3% |
| Nv_CG9012 | 77.0% |
| Nv_CG17927 | 75.9% |
| Nv_CG11522 | 75.9% |
| Nv_CG8055 | 74.8% |

TABLE 2-continued

Targets with insecticidal activity on *N. viridula*

| Target ID | % mortality |
|---|---|
| Nv_CG2331 | 72.6% |
| Nv_CG13389 | 61.7% |
| Nv_CG7178 | 57.3% |
| Nv_CG10305 | 52.9% |
| Nv_CG4759 | 47.4% |
| Nv_CG10305 | 37.6% |
| Nv_CG1475 | 33.2% |

Results shown in Table 2 indicate the insecticidal activity of the dsRNA molecules derived from *N. viridula* coding sequences on *N. viridula*. Based on the high insecticidal activity in both stink bug species, targets were selected for bacterial production of dsRNA and soybean transformation.

Example 3

Producing Targeted dsRNA Molecules by Bacterial Expression

This example describes producing dsRNA molecules engineered against identified stink bug targets using a bacterial expression system.

Hairpin cassettes were engineered for four selected stink bug targets. The hairpin cassette comprises a T7 promoter operably linked to an antisense sequence of the target, further linked at the 3'end to a nucleic acid sequence which is capable of forming a loop structure, further linked at the 3'end to the corresponding sense sequence of the target, operably linked at the 3'end to a T7 terminator sequence. The hairpin cassette was introduced into bacterial expression vector pGCP295 via BamHI and NotI restriction sites. The vector was then introduced into *Escherichia coli* strain HT115(DE3)GA01 via electroporation using standard methods, and transformants were selected for using kanamycin selection.

The bacteria containing the targeted dsRNA expression vector plasmid were grown in defined medium to a specific optical density unit (OD units; U) and induced by addition of IPTG for a specific time period following standard methods and routine optimization. After induction, the bacteria were subjected to heat treatment and centrifugation, and the produced dsRNA molecules were collected.

Example 4

Activity of dsRNA Molecules in a Spray Application Assay

This example describes testing of a sub-set of the identified target dsRNAs of the invention for biological activity against stink bugs when applied as a spray.

Three 3 week old soy bean plants (Glycine max (L.) Jack) were sprayed with a 15% sucrose solution containing 75U/ml bacterial lysate expressing non targeting GFP dsRNA and target dsRNA molecules from the expression vectors described above. 25 second instar nymphs were then placed on each sprayed plant. Plants were placed in a box coated with fluon PTFE to prevent stink bug escape and stored in a rearing chamber (26° C., 65% RH, with 16:8 hours l:d). Photographs were taken on a daily basis to record plant health. The nymphal survival rate was recorded 3 to 14 days post exposure to the sprayed plant. These experiments were performed using either *E. heros* or *N. viridula* nymphs. dsRNA of non target GFP was used as a negative control and dsRNA designed against a known *N. viridula* target gene was used as positive control. Percent mortality of the nymphs by day 14 are shown in Table 3.

TABLE 3

Spray Application Assay

| SEQ ID | Target ID | *N. viridula* % mortality | *E. heros* % mortality |
|---|---|---|---|
|  | negative con. | 2.7 | 17 |
| 16 | Nv_CG2331 | 65.8 | 4.1 |
| 38 | Nv_CG3948 | 35.7 | 39.1 |
| 33 | Nv_CG17927 | 36 | 31 |
| 3 | Nv_CG6213 | 42.5 | 43.2 |
| 53 | Nv_CG32744 | 98.8 | 63 |
| 27 | Nv_CG13389 | 49 | NA |
| 13 | Nv_CG14813 | 50 | NA |
| 37 | Nv_CG4651 | 52 | NA |
| 9 | Nv_CG2746 | 53 | NA |
| 44 | Nv_CG6253 | 53 | NA |
| 51 | Nv_CG10305 | 53 | NA |
| 35 | Nv_CG11522 | 58 | NA |
| 54 | Nv_CG7178 | 59 | NA |
| 42 | Nv_CG6846 | 59 | NA |
| 31 | Nv_CG4759 | 73 | NA |
| 39 | Nv_CG8385 | 75 | NA |
| 26 | Nv_CG8055 | 95 | NA |

Results in Table 3 indicate that the dsRNA molecule retain insecticidal activity when applied onto the surface of plants on which the stink bug feeds.

Example 5

Activity of dsRNA Molecules Against *Piezodorus guildinii*

This example describes testing dsRNAs derived from the orthologous *P. guildinii* target genes for biological activity against the stink bug *P. guildinii*.

Templates for dsRNA production were synthesized by PCR on cDNA prepared from *P. guildinii* at different life stages using methods similar to that of Example 1. The dsRNA molecules were produced using methods similar to that of Example 2. The dsRNA molecules were tested for toxicity against 12 second instar nymphs of *P. guildinii* in laboratory bioassays using methods similar to that of Example 2. Results are shown in Table 4. Percent mortality above the negative control (Abbot corrected; Abbott, 1925, J. Econ. Entomology 18: 265-267) at 7 days post-exposure are shown. The Flybase ID (found at the flybase.org website), which is based on the putative orthologous *D. melanogaster* gene, is also shown with the corresponding putative gene name or function.

TABLE 4

Targets with insecticidal activity on *P. guildinii*

| SEQ ID NO | Target ID | flybase ID | flybase symbol | % mortality | % Identity compared to: | | | |
|---|---|---|---|---|---|---|---|---|
| | | | | | Eh | Nv | Dm | Hh |
| 403 | Pg_CG5271 | CG5271 | RpS27A | 70 | 89.6 | 92.99 | 91.95 | 91.3 |
| 407 | Pg_CG3948 | CG3948 | zetaCOP | 70 | 91.62 | 91.62 | NA | 91.06 |
| 419 | Pg_CG2960 | CG2960 | RpL40 | 40 | 64.83 | 92.76 | 81.94 | 91.73 |
| | negative con. | | | 0 | | | | |

Results in Table 4 indicate the insecticidal activity of dsRNAs derived from *P. guildinii* targets Pg_CG5271, Pg_CG3948, and Pg_CG2960 on *P. guildinii*. These result further support that targets which are found to be insecticidal for one stink bug species can be insecticidal in a second stink bug species.

Example 6

Activity of dsRNA Molecules Against Other Stink Bugs

This example further describes testing dsRNAs derived from *N. viridula* target genes for biological activity against the stink bug *Piezodorus guildinii* (Small Green Stink Bug, SGSB), *Halomorpha halys* (Brown Marmorated Stink Bug, BMSB), and *Dichelops melacanthus*

The dsRNA molecules described above in Example 2 are tested for toxicity against second instar nymphs of *P. guildinii*, *H. halys*, and/or *D. melacanthus*, in laboratory bioassays. In vitro assays on each stink bug are performed in 96-well nylon mesh filter plates. Each well of a 96-well filter plate houses a second instar nymph which is exposed to a parafilm sachet containing a mixture of 15% sucrose and 1 μg/μl dsRNA. Plates are stored in plastic boxes in the rearing chamber at 26° C., 65% RH, and 16:8 hours light: dark. Three days post infestation, nymphs may be transferred to a petridish containing a filter paper and a runner bean (*Phaseolus coccineus*) or another suitable feeding source. Mortality is recorded from 3 to 14 days post exposure to dsRNA. dsRNA of non target GFP is used as a negative control.

Example 7

Activity of Orthologous dsRNA Molecules on Multiple Stink Bug Species

This example describes testing dsRNAs derived from orthologs of the *N. viridula* target genes identified in Example 2 for biological activity on each of the stink bug species *N. viridula*, *E. heros*, *P. guildinii*, *H. halys*, and *D. melacanthus*.

Table 5 shows the *N. viridula* target ID and SEQ ID NO of the coding sequence of the gene target; the gene target is the same as that of Table 1. Table 5 also provides the SEQ ID NO of the orthologous target of *P. guildinii* (Pg SEQ ID NO) and *H. halys* (Hh SEQ ID NO). Table 5 also provides references to the publicly available sequences of the orthologous targets of *D. melacanthus* (Dm ref) and *E. heros* (Eh ref) at the NCBI databases. The sequences for these stink bugs are the same as were analyzed for Example 2 and Table 1. The *D. melacanthus* sequences are identified by reference to Accession Numbers for databases publicly available at the NCBI website (prefix GBES-), are predicted based on analysis of publicly available transcriptome data (prefix DN-), or no *D. melacanthus* ortholog is currently known (not available; NA). The *E. heros* sequences are identified by reference to Accession Numbers for databases publicly available at the NCBI website (prefix GBER- or KT-), or no *E. heros* ortholog is currently known (not available, NA).

dsRNA molecules of the *E. heros*, *P. guildinii*, *H. halys*, and *D. melacanthus* orthologous genes identified and described in Example 2 and Table 5 are produced following methods similar to those described in Example 1. Laboratory bioassays for each stink bug species described (*N. viridula*, *E. heros*, *P. guildinii*, *H. halys*, and *D. melacanthus*) with each of the dsRNA molecules produced based on the sequences described in Table 5 are performed following methods similar to those described in Example 2 and Example 4. Results are expected to indicate that dsRNA molecules produced against the orthologous targets are insecticidal on all stink bug species described.

TABLE 5

Expected insecticidal targets orthologous to *N. viridula* insecticidal targets

| Nv TargetID | Nv SEQ ID NO | Pg SEQ ID NO | Hh SEQ ID NO | Dm ref | Eh ref |
|---|---|---|---|---|---|
| Nv_CG32744 | 215 | 430 | 538 | NA | GBER01009255.1 |
| Nv_CG7622 | 163 | 379 | 539 | GBES01005047.1 | GBER01015726.1 |
| Nv_CG1088 | 164 | 380 | 540 | GBES01002363.1 | GBER01000757.1 |
| Nv_CG6213 | 165 | 381 | 541 | GBES01003467.1 | GBER01016875.1 |
| Nv_CG10370 | 166 | 382 | 542 | DN138443 | GBER01015830.1 |
| Nv_CG2960 | 167 | 383 | 543 | DN323553 | GBER01012130.1 |
| Nv_CG3455 | 168 | 384 | 544 | GBES01001459.1 | GBER01004440.1 |
| Nv_CG10149 | 169 | 385 | 545 | GBES01002734.1 | GBER01001814.1 |
| Nv_CG12775 | 170 | 386 | 546 | GBES01007121.1 | GBER01006928.1 |
| Nv_CG2746 | 171 | 387 | 547 | GBES01005773.1 | GBER01000776.1 |
| Nv_CG17420 | 172 | 388 | 548 | GBES01003010.1 | KT819630.1 |
| Nv_CG4027 | 173 | xxx | 549 | GBES01003011.1 | KT369806.1 |

TABLE 5-continued

Expected insecticidal targets orthologous to *N. viridula* insecticidal targets

| Nv TargetID | Nv SEQ ID NO | Pg SEQ ID NO | Hh SEQ ID NO | Dm ref | Eh ref |
|---|---|---|---|---|---|
| Nv_CG5178 | 174 | 389 | 550 | GBES01006994.1 | GBER01015556.1 |
| Nv_CG14813 | 175 | 390 | 551 | NA | GBER01001573.1 |
| Nv_CG9075 | 176 | 391 | 552 | GBES01007849.1 | GBER01005756.1 |
| Nv_CG11276 | 177 | 392 | 553 | GBES01003467.1 | GBER01001973.1 |
| Nv_CG2331 | 178 | 393 | 554 | GBES01003153.1 | GBER01017480.1 |
| Nv_CG11271 | 179 | 394 | 555 | DN142066 | GBER01013483.1 |
| Nv_CG33859 | 180 | 395 | 556 | NA | GBER01007350.1 |
| Nv_CG3722 | 181 | 396 | 557 | GBES01007153.1 | GBER01004688.1 |
| Nv_CG7107 | 182 | 397 | 558 | GBES01000713.1 | GBER01000416.1 |
| Nv_CG4898 | 183 | 398 | 559 | GBES01000971.1 | GBER01005999.1 |
| Nv_CG2168 | 184 | 399 | 560 | GBES01007768.1 | GBER01012502.1 |
| Nv_CG17521 | 185 | 400 | 561 | GBES01000091.1 | GBER01000652.1 |
| Nv_CG6779 | 186 | 401 | 562 | GBES01008054.1 | GBER01014585.1 |
| Nv_CG4087 | 187 | 402 | 563 | GBES01006993.1 | GBER01001611.1 |
| Nv_CG8055 | 188 | 403 | 564 | GBES01005648.1 | GBER01009957.1 |
| Nv_CG13389 | 189 | 404 | 565 | GBES01001416.1 | NA |
| Nv_CG5502 | 190 | 405 | 566 | GBES01000140.1 | GBER01005380.1 |
| Nv_CG1475 | 191 | 406 | 567 | NA | GBER01010886.1 |
| Nv_CG13109 | 192 | 407 | 568 | GBES01004074.1 | GBER01014237.1 |
| Nv_CG4759 | 193 | 408 | 569 | GBES01002213.1 | GBER01002337.1 |
| Nv_CG7726 | 194 | 409 | 570 | GBES01001201.1 | GBER01000311.1 |
| Nv_CG17927 | 195 | 410 | 571 | DN85615 | GBER01003268.1 |
| Nv_CG1519 | 196 | 411 | 572 | GBES01000608.1 | GBER01005333.1 |
| Nv_CG11522 | 197 | 412 | 573 | GBES01001456.1 | GBER01005038.1 |
| Nv_CG8186 | 198 | 413 | 574 | GBES01001237.1 | GBER01011436.1 |
| Nv_CG4651 | 199 | 414 | 575 | NA | GBER01011108.1 |
| Nv_CG3948 | 200 | 415 | 576 | NA | GBER01005643.1 |
| Nv_CG8385 | 201 | 416 | 577 | NA | NA |
| Nv_CG3949 | 202 | 417 | 578 | DN319110 | GBER01001506.1 |
| Nv_CG1341 | 203 | 418 | 579 | GBES01002663.1 | GBER01013464.1 |
| Nv_CG6846 | 204 | 419 | 580 | NA | NA |
| Nv_CG6223 | 205 | 420 | 581 | GBES01001379.1 | GBER01003082.1 |
| Nv_CG6253 | 206 | 421 | 582 | DN276483 | GBER01015811.1 |
| Nv_CG9012 | 207 | 422 | 583 | GBES01006613.1 | GBER01014313.1 |
| Nv_CG5271 | 208 | 423 | 584 | GBES01000679.1 | GBER01005948.1 |
| Nv_CG3395 | 209 | 424 | 585 | NA | GBER01013565.1 |
| Nv_CG3329 | 210 | 425 | 586 | NA | GBER01007427.1 |
| Nv_CG5266 | 211 | 426 | 587 | GBES01002799.1 | GBER01001876.1 |
| Nv_CG7434 | 212 | 427 | 588 | NA | GBER01013590.1 |
| Nv_CG10305 | 213 | 428 | 589 | GBES01003463.1 | GBER01007350.1 |
| Nv_CG17489 | 214 | 429 | 590 | DN138443 | GBER01015830.1 |
| Nv_CG7178 | 216 | 431 | 591 | NA | GBER01000646.1 |

Example 8

Expression of an Interfering RNA Molecule Comprising Target dsRNA in Soybean Plants This example describes introducing a construct that expresses an interfering RNA molecule into plant cells.

Vector Construction

A binary vector comprising at least one expression cassette designed to produce a hairpin RNA (hpRNA) comprising a promoter operably linked to a sense strand of a target nucleic acid sequence, an intron functioning as a loop sequence, a corresponding an antisense strand, and a terminator. The binary vector may also comprise a second cassette between the left and right T-DNA borders, designed to express a selectable marker for use in selection of transformed plant cells. The binary vector may also contain selectable markers for selection of transformed bacteria, for example transformed *Agrobacterium tumefaciens* bacterial cells which contain the binary vector.

Soybean Transformation

Soybean plant material can be suitably transformed and fertile plants regenerated by many methods which are well known to one of skill in the art. For example, fertile morphologically normal transgenic soybean plants may be obtained by: 1) production of somatic embryogenic tissue from, e.g., immature cotyledon, hypocotyl or other suitable tissue; 2) transformation by particle bombardment or infection with *Agrobacterium*; and 3) regeneration of plants. In one example, as described in U.S. Pat. No. 5,024,944, cotyledon tissue is excised from immature embryos of soybean, optionally with the embryonic axis removed, and cultured on hormone-containing medium so as to form somatic embryogenic plant material. This material is transformed using, for example, direct DNA methods, DNA coated microprojectile bombardment or infection with Agrobacterium, cultured on a suitable selection medium and regenerated, optionally also in the continued presence of selecting agent, into fertile transgenic soybean plants. Selection agents may be antibiotics such as kanamycin, hygromycin, or herbicides such as an HPPD inhibitor, phosphinothricin, or glyphosate or, alternatively, selection may be based upon expression of a visualisable marker gene such as GUS. Target tissues for transformation include meristematic tissue, somaclonal embryogenic tissue, and flower or flower-forming tissue. Other examples of soybean transformation include physical DNA delivery methods, such as particle bombardment (see e.g., Finer & McMullen, In Vitro Cell Dev. Biol., 1991, 27P:175-182; McCabe et al., Bio/technology, 1998, 6:923-926), whisker (Khalafalla et al., African J.

of Biotechnology, 2006, 5:1594-1599), aerosol bean injection (U.S. Pat. No. 7,001,754), or by Agrobacterium-mediated delivery methods (Hinchee et al., Bio/Technology, 1988, 6:915-922; U.S. Pat. No. 7,002,058; U.S. Patent Application Publication Nos. 20040034889 and 20080229447; Paz et al., Plant Cell Report, 2006, 25:206-213).

Soybean transgenic plants can be generated with the above described binary vector containing an expression cassette capable of producing an interfering RNA molecule using any available transformation method. Optionally, an interfering RNA molecule expression cassette can be present in the T-DNA alongside other sequences which provide additional means of selection/identification of transformed tissue including, for example, the known genes which provide resistance to kanamycin, hygromycin, phosphinothricin, butafenacil, or glyphosate. For example, different binary vectors containing PAT or EPSPS selectable marker genes are known in the art (see e.g., U.S. Patent Application Publication No. 20080229447). Alternatively, selectable marker sequences may be present on separate polynucleotides and a process of, for example, co-transformation and co-selection is used. A scorable marker gene such as GU.S. may also be used to identify transformed tissue.

T0 plants are taken from tissue culture to the greenhouse where they are transplanted into water-saturated soil (REDI-EARTH® Plug and Seedling Mix, Sun Gro Horticulture, Bellevue, Wash., or Fafard Germinating Mix) mixed with 1% granular MARATHON® (Olympic Horticultural Products, Co., Mainland, Pa.) at 5-10 g/gal soil in 2" square pots. The plants are covered with humidity domes and placed in a Conviron chamber (Pembina, N.Dak.) with the following environmental conditions: 24° C. day; 20° C. night; 16-23 hours light-1-8 hours dark photoperiod; 80% relative humidity.

After plants became established in the soil and new growth appeared (~1-2 weeks), plants are sampled and tested for the presence of desired transgene by TAQMAN® analysis using appropriate probes for the interfering RNA expression cassette, including for example for promoters (for example prCMP). Positive plants are transplanted into 4" square pots containing Fafard #3 soil. Sierra 17-6-12 slow release fertilizer may be incorporated into the soil at the recommended rate. The plants are then relocated into a standard greenhouse to acclimatize (~1 week). The environmental conditions are: 27° C. day; 21° C. night; 14 hour photoperiod (with supplemental light); ambient humidity. After acclimatizing (~1 week), the plants are sampled and tested in detail for the presence and copy number of inserted transgenes. Transgenic soybean plants may then be assayed for resistance to stink bug species by a feeding assay, and/or they may be grown to maturity for T1 seed production. T1 plants may be grown and may also be assayed for resistance to stink bug species by a feeding assay.

Example 10

Interfering RNA Molecules with a Second Insecticidal Agent Bioassays

Double stranded RNA molecules are produced against an insecticidal target selected from the targets shown in Table 1. Additionally, a second insecticidal agent is prepared. Both the RNA and the second insecticidal agent are tested in combination for toxicity against stink bug species in laboratory bioassays similar to those described in Example 2.

It should be understood that the examples and embodiments described herein are for illustrative purposes only and that various modifications or changes in light thereof of the description will be suggested to persons skilled in the art and are to be included within the spirit and purview of this application and the scope of the appended claims.

All publications and patent applications mentioned in this specification are indicative of the level of skill of those skilled in the art that this invention pertains. All publications and, patent applications are herein incorporated by reference to the same extent as if each individual publication or patent application was specifically and individually indicated to be incorporated by reference.

Example 11

Activity of dsRNA Molecules in a Spray Application Assay Against *Piezodorus guildinii*

This example describes testing of a sub-set of the identified target dsRNAs of the invention for biological activity against *P. guildinii* stink bugs when applied as a spray, following the same setup as example 4.

Three 3 week old soy bean plants (Glycine max (L.) Jack) were sprayed with a 15% sucrose solution containing 75U/ml bacterial lysate expressing non targeting GFP dsRNA and target dsRNA molecules from the expression vectors described above. 25 second instar *P. guildinii* nymphs were then placed on each sprayed plant. Plants were placed in a box coated with fluon PTFE to prevent stink bug escape and stored in a rearing chamber (26° C., 65% RH, with 16:8 hours I:d). The nymphal survival rate was recorded 3 to 14 days post exposure to the sprayed plant dsRNA of non target GFP was used as a negative control and dsRNA designed against a known *N. viridula* target gene was used as positive control. Percent mortality of the nymphs by day 14 are shown in Table 6.

TABLE 6

Spray Application Assay with *P. guildinii* nymphs

| SEQ ID | Target ID | *P. guildinii* (% mortality) |
|---|---|---|
|  | negative con. | 7 |
| 16 | Nv_CG2331 | 61 |
| 38 | Nv_CG3948 | NA |
| 33 | Nv_CG17927 | 83 |
| 3 | Nv_CG6213 | 86 |
| 53 | Nv_CG32744 | NA |
| 27 | Nv_CG13389 | 81 |
| 13 | Nv_CG14813 | 85 |
| 37 | Nv_CG4651 | NA |
| 9 | Nv_CG2746 | 82 |
| 44 | Nv_CG6253 | NA |
| 51 | Nv_CG10305 | NA |
| 35 | Nv_CG11522 | 94 |
| 54 | Nv_CG7178 | 86 |
| 42 | Nv_CG6846 | NA |
| 31 | Nv_CG4759 | NA |
| 39 | Nv_CG8385 | 55 |
| 26 | Nv_CG8055 | 88 |

Results in Table 6 indicate that the *N. viridula* dsRNA molecule retain insecticidal activity when applied onto the surface of plants on which the *P. guildinii* stink bug feeds.

Example 12

Activity of dsRNA Molecules Against *Piezodorus guildinii*

This example describes testing dsRNAs derived from the orthologous *P. guildinii* target genes for biological activity against the redbanded soy stink bug *P. guildinii*.

Templates for dsRNA production were synthesized by PCR on cDNA prepared from *P. guildinii* at different life stages using methods similar to that of Example 1. The dsRNA molecules were produced using methods similar to that of Example 2. The dsRNA molecules were tested for toxicity against 24 second instar nymphs of *P. guildinii* in laboratory bioassays using a liquid diet based assay in 6-well plates. dsRNA molecules were diluted to 1 µg/µl in 15% sucrose solution. 100 µl of the dsRNA solution was pipetted in 6 wells of a 96-well plate. The 96-well plate was sealed, pierced and placed upside down on a 6-well plate containing the insects. Eight second instar nymphs were placed in each well and 24 nymphs were tested per treatment. The dsRNA solution was provided to the nymphs for 5 days. On day 5 the diet was refreshed with 200 µl sucrose solution (15%). Mortality was recorded 3, 4, 5, 6, 7, 10, 11 and 12 days post-infestation. dsRNA of non-target GFP was used as a negative control and dsRNA designed to target an ubiquitin gene of *P. guildinii* was used as a positive control. Plates were stored at 26° C. and 70% RH, with a 16 hour: 8 hour light:dark photoperiod. Results are shown in Table 7. Percent mortality above the negative control (Abbot corrected; Abbott, 1925, J. Econ. Entomology 18: 265-267) at 14 days post-exposure are shown. The Flybase ID (found at the flybase.org website), which is based on the putative orthologous *D. melanogaster* gene, is also shown with the corresponding putative gene name or function.

TABLE 7

Activity of dsRNA molecules against *Piezodorus guildinii*

| SEQ ID NO | Target ID | flybase ID | flybase symbol | Abbott corrected % mortality |
|---|---|---|---|---|
| 843 | Pg_CG8385 | CG8385 | Arf79F | 33.3 |
| 857 | Pg_CG7178 | CG7178 | troponin | 40 |
| 824 | Pg_CG2746 | CG2746 | RpL19 | 53.3 |
| 842 | Pg_CG3948 | CG3948 | zetaCOP | 51.3 |
| 848 | Pg_CG6253 | CG6253 | RpL14 | 61.6 |
| 846 | Pg_CG6846 | CG6846 | RpL26 | 60 |
| 839 | Pg_CG11522 | CG11522 | RpL6 | 46.7 |
| 830 | Pg_CG8055 | CG8055 | shrb | 80 |
| 808 | Pg_CG6213 | CG6213 | Vha13 | 60 |
| 841 | Pg_CG4651 | CG4651 | RpL13 | 73.3 |
| 820 | Pg_CG2331 | CG2331 | TER94 | 66.7 |
| 855 | Pg_CG10305 | CG10305 | RpS26 | 86.7 |
| 858 | Pg_CG32744 | CG32744 | Ubi-5pE | 93.3 |

SEQUENCE LISTING (858 sequences)

SEQ ID NO: 1 - DNA, 290 bp, artificial sequence
  Nezara viridula
tgaaatggctgttggtcttaaaaaaggtcacaggacaaccaagattgtaatgggaaagtccaaagctgataagaagcacaaaattagaccatcacgcctgaaaggtagacaaaccaagcatacaaagtttgttagagatttgatcagagaagtatgcggtcatgcaccttatgaaaagagaggaatggagttgctcaagatttccaaggataagagggctttgaaatttttgaagagaaggatcggcactcacatccgtgctaagaggaagagggaagaacttagcaaca

SEQ ID NO: 2 - DNA, 641 bp, artificial sequence
  Nezara viridula
gacgcagatgtacaaaaacaaatcaagcacatgatggccttcattgagcaggaggccaatgaaaaggctgaagaaattgatcaaaaagctgaagaagaattcaatattgagaaaggaaggcttgttcagaatcaaagattaaagatcatggaatattatgaaagaaaagaaaaacaggtggaacttcaaaagaaaatccaatcttcaaatatgttgaatcaagctcgactcaaagctttgaaaatacgtgaagatcatgttcgcgatgtactcgatgaggccaggaagagactgttgcaatcagtcaaagacgaagcacgttacaaagatatccttgagaaactcatgcttcaggggttgtaccagttgatggaatcagacattttggttagaactcgtgaaatggatggcccagttgtgagctcagtgttccctgatgtgctggtgaaatacaaggaatcatcaggtaaggatttgcagctgaagttggatacagaattgtacttaccatctgaatgtgctggtggcattgaactttacactgcgagaggccgtatcaagattgttaacactcttgaatccaggcttgatcttatttcagcacaattgttgcctcaaattagaacatccttattcggtcg

SEQ ID NO: 3 - DNA, 319 bp, artificial sequence
  Nezara viridula
actcaagggattcagcaattattagcggctgagaaaagagctgctgaaaaagttgctgaggcgaaaaaacgcaaggctaggcgtctaaagcaagccaaagaagaggcccaagaagaaattgaaagatacaagcaagacagagagaaacagttcagggagtttgaagctcagcatatgggctcacgagaagatgttgcagcaaggatagatgctgatacacgccaaaagattgaagaaatgaatgaagcagttaatgctaacaaagaagcagttattcaaagaattttggaattggtttacgatatcagaccagagatgc

SEQ ID NO: 4 - DNA, 767 bp, artificial sequence
  Nezara viridula
gaaagaccaactgagcagtattcagacattggtgggctagacaaacagattcaagagctaattgaagctgttgttcttcccatgacccacaaagaaaaatttgaaaatcttggaattcatcctcctaaaggtgtattactttatggacctcctggaacaggaaaaactttattggcaagagcgtgtgcagctcaaacaaaatctacttttctgaaacttgctggtccccagctagtacagatgttcattggggatggagccaaacttgttagagatgcttttgctcttgctaaagaaaaatctccagctattatatttattgatgagttggatgctattgggacaaaaagatttgattctgaaaaggctggtgatcgagaagttcaaagaactatgttagagttactcaaccagttagatggatttagttcaacagctgacataaaggttattgctgctacaaatagagtagatattttggatcctgcccttttgcgttctggacgactcgataggaaaattgaattcccacatcctaatgaagatgctagagcacgtataatgcaaatacattcccgtaaaatgaatattagtgtagatgtgaattttgaagaacttgctcgttcaaccgatgatttcaatggagctcagtgtaaagctgtttgtgtggaggctggtatgatagctttgcgtcgaggagctggagtagttacccatgaagatttcatggatgcaatattggaagtacaagcaaagaagaaagccaa

SEQ ID NO: 5 - DNA, 344 bp, artificial sequence
  Nezara viridula
cctcacgggtaaaaccattaccctagaggttgaaccttctgatactattgaaaatgtgaaagctaagattcaagacaaagagggaattcctccagatcagcagaggcttatttttgctggtaaacaattggaagatggaagaactttgtctgattacaacattcaaaaagaatctactcttcatttggtccttcgtctgaggggtggtgtcattgaaccaactctcaaaattcttgcacagaaatacaattgtgacaagatgatttgccgcaagtgctacgctaggcttcacccgagggcaactaactgccgcaagaagaaatgtgggcataccaacaatatcc

SEQ ID NO: 6 - DNA, 718 bp, artificial sequence
  Nezara viridula
gaaccaaacagagaaaaggctttacaagattatcgtaaaaaattactggagcataaagaagttgaagtcagacttaaagaaatgagagaccagttaaaagatcttaccaaacaatatgataaatctgaaaatgacttgaaagcccttcaaagtgttggtcagattgttggagaagtattaaagcagcttactgaagaaaaatttattgtcaaggctaccaatggtccaagatatgttgttggttgtagaagacaacttgataaattaaaacttaaatctggcacgagggtagcattggacatgacaactttaacaattatgcgacatttgccgagagaagttgatccattagtgtataacatgtctcatgaagatccaggagatgtaacatattctgctattggaggtcttgcagaacaaattagagaacttcgtgaggtgattgagctgcctctgttgaatcctgaactttttcaacgagttggtattactccacctaaaggatgtctactttacggccctcctggtactggaaagactttgttggccagagctgtagccagccaattagatgcaaacttccttaaggtagtctccagtgctatcgttgacaaatatattggagaaagtgctcgtctaattagagaaatgtttaattatgcaagagatcaccagccttgcataatttttatggatgaaattgatgctatcggaggtc

SEQ ID NO: 7 - DNA, 701 bp, artificial sequence
  Nezara viridula
agtgcgttctttggtagattatttcttggatcttgaagctggaataggaatagaagttcaactttgtaaagagtgtatcgaatgggctaaagatgaacacaggacttttctcaggcagtcactggaagctaggcttatcgctctatatttcgacacaggaatgtttacagaagcactacagcttggctcaagtcttcttaaagaattaaagaaattagatgataaaaatttgcttgttgaagtccttttgttggaatctaaaacttatcatgctttgagcaacctttcaaaagccagggctgctttgacatcagccaggacaactgctaattccatatattgtccacccaaaatgcaagcagccctcgatttgcaatctggtatattacacgcagcagatgaacaagatttcaaaacagcttactcatatttctatgaagcttttgaaggctatgatagtgtagagagcccaaaggctttagttgctcttaaatatatgcttctgagtaaaatcatgttaaacacaccagaagacgtgcagcagttggttagcgggaaacttgctcttaaacatgctggtaaagatattgatgcaatgaaatcagttgctcaagccagccataagagatcacttgctgatttccagctaactttaaaaaattacaagaaagagcttgaggaagatccaattgtacgagctc

SEQ ID NO: 8 - DNA, 432 bp, artificial sequence
  Nezara viridula
gtgatttgttttcacgtggttacaggaaacatggtgtcatcccactttcgacgtacatgaaagtatacaaagttggagatattgtatcgattaagggaaatggtgctgttcaaaagggtatgccccacaaaagttatcatgggaaaacaggacgagtttacaatgtaactcctagagctttgggtgtgatcgtcaacaaaagggtccgtggaaaaattctacctaagaggattaacatccgtattgaacatgtcaaccactccaagtgccgtgaagatttcttgaagcgtgtacgagaaaatgagaggctcaggaaagaggccaaagaaaagggcattcatgttgaattgagaagacagcctgcccagccacgacctgctcatttgataactgtcaaagagcctccaataatgctcgctcctataccttatg

SEQ ID NO: 9 - DNA, 625 bp, artificial sequence
  Nezara viridula
actggtctccatgttgttttctttcagtgtggaacttcgggattaccatgagttcgttgaagttacagaagaggctagcagcctctgttatgagatgtggtaaaaaaaaggtttggttagacccaaatgaaattaatgaaatagccaatacaaattcaagacaaaacatcaggaagttaatcaaagatggttttattatcaagaaacccgttgcagtacattccagggcccgtgttcgtaaaaatactgaagccagaaggaaaggtaggcattgtggtttcggtacaaggaaaggtactgctaatgcaagaatgccagcgaaggtgttgtgggtgaacagaatgagggttcttaggcggttactgaagaagtatagagaagccaagaaaattgataggcagatgtatcatgacttatacatgaaagcaaaaggtaatgtttttaaaaacaagcgtgtattgatggaatttattcataagaagaaagctgaaaaagctaggtccaaaatgctccgtgatcaagctgaagccaggaggcaaaaagttaaagaagcaaagaagcggcgagaagaaaggatcacaatgaagaaacaagaaatattacaatcttaccagagggaagatga

SEQ ID NO: 10 - DNA, 610 bp, artificial sequence
  Nezara viridula
gagtatcgaggaagctcttcgttcacgttaccgtgtttctacaagccttcattcgcaatgggggcttacaagtacatccaggaattgtacagaaaaaagcagtcagatgccatgaggtatctgctgcgaatcagggtttggcaatacagacagatgaccaagatgcaccgtgttgtgaagccttcaagacccgataaagctaggagattgggatttaagaataaacaaggtttctgtgtattcaggatccgtatcaagcgaggaggcaggaaacgcccagttccaaagggtgctacctatggcaaacctaaaagccatggagtaaaccagttgaaacctacaagaagtctccatgctatggctgaggaaaaagttggtaggaagtgcagtggattgagagtattaaactcttattgggtagcccaagacgccagatacaaatactacgaagtcatctgcgttgacccagctcacaaggcaatcagaagagatgctaaagccaactggatatgtgacccagtgcacaagcaccgtgagatgcgtggtaagactagcgctgctaggaagtcacgaggtcttggcaagggccacagatactcacagaccaagg

SEQ ID NO: 11 - DNA, 734 bp, artificial sequence
  Nezara viridula
cccaattgaacacggtattgtaactaactgggatgatatggaaaaaatttggcatcacactttctacaatgaacttcgagttgcgccagaagagcacccagttctcctgactgaagcacctttgaaccccaaagcaaatagggaaaaaatgacacagatcatgtttgaaacattcaacactccagctatgtatgttgccattcaagctgttctgtccctgtatgcatctggacgtaccaccggtattgttctggattctggagatggtgtctcacacactgtaccaatttatgaaggttatgctctacctcatgccatccttaggttggatttagctggacgtgacctcactgattacctcatgaagatcctgactgaaaggggatactccttcacgactactgctgagagagaaattgtgagggatatcaaggaaaaattgtgttatgttgctcttgactttgagcaggaaatggccactgctgccagttcaagttccctagaaaaatcttatgaacttcctgatggacaagttatcacaattggaaatgaaaggttccgatgccctgaagctctgttccagccttctttcttgggtatggaggcatgtggtatccatgagaccacttacaactcaatcatgaaatgtgatgtcgacattaggaaggacttgtatgccaatactgttctctctggaggtactaccatgtaccctggtattgctgataggatgc

SEQ ID NO: 12 - DNA, 754 bp, artificial sequence
  Nezara viridula
acatggaaaagatctggcatcacaccttctacaacgagctgcgagtcgctccagaggaacaccccatcctcctcaccgaggctcccctcaaccctaaagccaacagggagaagatgacccagatcatgtttgagaccttcaacaccccagccatgtatgtcgccatccaggctgtactctccctctatgcctccggtcgtaccaccggtattgtacttgactcaggagatggtgtatcccacaccgtacccatctatgaaggttatgcccttcctcacgccatcctccgtctggatcttgctggacgtgacttgactgactaccttatgaagatcctcaccgaacgtggttacagtttcacaaccaccgctgaaagggaaatcgtcagggacatcaaggaaaaactgtgctatgttgccctggactttgaacaggaaatggccaccgctgctgcctccacctccctcgagaagtcttatgaacttcctgacggtcaggtcatcaccatcggtaacgagaggttccgttgcccagaggctctcttccagccttccttcttgggtatggaatcttgcggtatccatgagactgtctacaactccatcatgaagtgcgatgttgacatcaggaaggacttgtacgccaacaccgtcctctccggaggtaccaccatgtacccaggtattgctgacaggatgcagaaggaaatcaccgccctcgctccttcaaccatcaagatcaagatcatcgctcc

SEQ ID NO: 13 - DNA, 799 bp, artificial sequence
  Nezara viridula
atcatcaacgtacactagccctgttgtcgaaactattgatctgcctaaacctacatacacacctgcgaaacctgtcttaacagcgaaagctatgaaactaggtggtaaatctagagatgtcgaatcatttgttgatcaactaaaatcagagggagaaaatgtgatttcacaagtggctgcgaataaacctgttgcagctaagttagcctctacaccaaatattcatatggaagaggtccatctaaaacaggaagaaaaactaatggtttctgtaggaaaggatggtggaatacaaagctttgagctccatggtttggtaacattacggataactgatgaaaaatatgctaagataaaagtatatctcgataacaaagataagagaggaattcagttgcagacgcatccgaacgtggataaagaattattcaaaatgaagtcgcagattggtttgaagaatccttcaaaaccatttcctttaggaactgatgtaggtgtacttaaatggcgataccaatctcaagatgaatctgcacttcctctaaccataaactgctggccatctgaaaatggacaaggaggatgtgatgtcaatattgagtatgagctcgaacattctcaccttgaactaaatgatgttaccatcaacattccattacctattgggtgctctcctgttgttgctgagtgtgatggcgagtacaaacacgagtcccgaaggaacttgctgcaatgggtactgccagttattgacaggagtaacaaatcaggagcgatggagttttcgacatcttctgct

SEQ ID NO: 14 - DNA, 722 bp, artificial sequence
  Nezara viridula
gtgttaggggtcatgatgttattgcccaagctcagtcaggtactggtaaaacagctacattttccatttcaatattacaacaaattgacactagtgcaagagaatgccaggccttgattttggccccaactcgtgaattggcccaacagatccagaaagtagtcatagccctgggagattttatgggggccatgtgccatgcatgcattggtggtacaaatgttagagaagacatgcgcaaactagaaatgggtgttcatgttttggttggaactcccggacgagttttggatatgattagccgcagagctctaaaaactaacaccattagaatttttgtgttggatgaagctgatgagatgctttctcgtggtttcaaagatcagatccatgatgtatttaaaaatttaaatcatgaagtacaggttatattgctttcagctactatgccatcagatgtattggaggtcagtacatgcttcatgaggaatcctattcgtatcttagttaaaaaagaagaacttaccttggaaggtatcaaacagttttttgtttttgttgagagagaagagtggaagttggatactctctgtgatttgtatgaaacactaagtattactcaagctgtaattttttgtaatacaaggcgcaaggttgattggttgactgagagtatgcataatagagacttcactgtttctgctatgcacggtgatatggaa

SEQ ID NO: 15 - DNA, 700 bp, artificial sequence
  Nezara viridula
gcgtttaaatgctccaaaatcatggatgttggacaagcttggtggtgtttttgcgccaaggcccagctcaggtccacacaaacttagggaatcattgcccttagtaatttttctccgtaatagactaaagtatgcacttacaaatactgaagtaactaaaatcgtgatgcagcgtctcataaaaattgatggcaaagtgaggacagaccctaactaccctgcaggtttcatggatgtgattagcattgagaaaactggtgaatttttccgattgatctatgatgttaaggggcgttatgctattcacagaattactgctgatgaagccaagtacaagctgtgcaaggttaaaagggtgcagactgggcctaagggtattccttacttagttacccacgacgctagaaccatcaggtacccagatccactcgtgaaagttcatgataccattcagcttgatattgctactggcaaaatcatcgatatcatccgaatggagtcaggtaacctttgcatgattactggaggtcgtaacttgggaagagttggtactgttgtaaacagggagagacatcctggatccttcgatatcgttcatatcaaggatgccagtggccacacctttgccacacggttgaacaatgtgttcatcattggtaagggtagcaaagcttacgtttcattacctaaaggcaagggt

SEQ ID NO: 16 - DNA, 702 bp, artificial sequence
  Nezara viridula
attgttatggctgctaccaacaggcctaattcaattgatgctgctcttagacgtttcggacgatttgatcgtgagattgatattggtattccagatactactggacgtttagaagttcttcgaattcacacaaaaaatatgaaacttgctgatgatgttaatttagaacagattgcagccgaaacacatggtcatgttggtgctgatttagcatctctctgttcagaagcagctcttcaacagattcgtgaaaaaatggatctaattgatttagaagaagaccaaattgatgccgaagttcttaattctcttgctgttaccatggataacttcaggtatgctatgggcaaaagtagccctagtgcccttcgtgaaacagtggttgaagttcctaatattacttgggatgatattggtggtctcgataatgttaaaaaagagttacaagaattagttcagtatcctgttgaacatccagagaagttcttgaagtttggaatgcaaccttcccgtggtgttttgttttatggaccaccaggttgtggtaagactttgttggccaaagctattgctaatgaatgccaggccaacttcatctcggttaagggtcctgaattattaactatgtggtttggagaatccgaagctaatgtccgtgatatttttgataaggctagagctgctgcaccatgtgttcttttt

SEQ ID NO: 17 - DNA, 335 bp, artificial sequence
  Nezara viridula
actattgaagacgaatcgggcccatctggcgactcagtggacataaataccgctcttaaagaagtactaaaaggagttgtgagaaatggagtcatagtacatggtctgagggagtcagctaaagctcttgacaagcgacaggcattactgtgtgttctggccgaaaactgtgatgagcccatgtacaagaagcttgtgcaagctctctgctcagaacatcaaataccattagttaaggtcgactccaacaaaaaattaggagaatggtccggtttatgtaaaatcgacaagacaggaaacccaaggaaagttgttgggtgctcttgtgtagttat

SEQ ID NO: 18 - DNA, 379 bp, artificial sequence
  Nezara viridula
atagcagaaggatgtctggacgtggcaaaggtggcaaagccaagggaaaggcaaagacccgatcatctagggcaggactccagttccccgtcggtcgtatccaccgtctcctcaggaaaggtaactacgccgagagggtgggagcaggagctccggtgtacctcgcagcagtcatggaatacctggctgccgaagttctcgagttggccggcaacgcagctcgtgataacaagaagactaggatcatcccgcgtcatctccagctcgccataaggaacgacgaggagttgaacaagctgttgtcgggagtcaccatcgctcaaggcggagtacttcccaacatccaggccgttctgctgccgaagaagacagagaagag

SEQ ID NO: 19 - DNA, 729 bp, artificial sequence
  Nezara viridula
ctcacagtgtatcagctaccgtcaatgttactgtcaaagaaataccagaagaagctgttgataagtcaggttctgttcgtttagttggaattactgctgaagaatttatagaagctaattctaatggtatcagcaagagaactatgttcaggaaatatttagcaaaattcttgaacattactgaagaaaatgttgatgtgtttactgttttacattctccacacaatacaaatacaagtctactggatgttcgattttcagctcatggttctccttattatagtccagaaaaactgaatgcagcagtgagcgtgcataatgctgaattggagaaagagcttggagttgcgattctcatggtgaacatagatgaatgtctcattgaaaggcagtactgtgagggttcatgtattaattttctgaataaaagtcgtgagccgatcgccgtttacactaatacaacaacttttgttggtgtgagagctgttgtagatcctttttgtaattgtgaggtactttcaaggccagtttgttataatggtggtacacttattaacgacaagtgtgaatgtgaacctggctttgaaggacctcattgtgagatcctaagtgttggatttaatggaaatggatgggccctttatcctccattagaatcttgtgctgattcacatctgtctttggaacttcgttccaataaaaaggatggtcttgtgttttacctagggc

SEQ ID NO: 20 - DNA, 702 bp, artificial sequence
  Nezara viridula
agcctcaaaagaagactgagggcgatggagatccagaatttgtaaaacgccaggaagctaaaacatcagctttggatgaacaactcaaggactacatcgcagaatggagaaaacaaagagcgaaagaggaagaggacctgaagcgcctcaaagaaaagcaagccaagagaaaggtcatgagagctgaagaagaaaagaggctcgctgaaaagaaaaagcaagaggaagaaaggcgagtcagagaagctgaagaaaagaaacagagagatattgaagaaaagaggcgtagacttgaggaagcagaaaaaaaacgacaggctatgatggcagctcttaaggatcaaagtaaaagcaagggtccaaacttcacaatcagcaaaaaggaagctggtctaaacttgtcttcagcacaaatagaaaggaacaaaacaaaggaacaattagaagaagaaaagcgtatttcccttagcataaggattaaaccattaagtattgaaaatcttaacattgacagattacgattaaaagctattgaactctgggattgcattgttaaactggaaactgagaaatatgatcttgaggaaagacaaaaacgtcaagattatgatcttaaagaactgaaggagagacaaaagcagcaactgaggcataaagcactgaagaaaggtttagacccagaggctttgactggcaaatatc

SEQ ID NO: 21 - DNA, 792 bp, artificial sequence
  Nezara viridula
tcaagaagaagatgcaagctatgaagcttgagaaggacaacgcgatggatcgcgccctcctgtgcgagcagcaggccagggatgccaacctgagggcagagaaggctgaggaggaggccaggtccttgcagaagaagatccaagccattgagaacgacttggaccaaacacaggagcagttgatgcaggtcttgcagaagcttgaggataaggataaggctctccaaaacgctgagagcgaggtcgccgccctcaacagacgtatccaactgttggaggaggacctcgaaaggtctgaggaaagattggccaccgcaacagctaaactggccgaagcctcccaagcagcagatgagtccgaaaggcagagaaaggttcttgagaaccgcagcttggctgatgaagagcgcatggacgcacttgaaaatcagctgaaagaagccagatttctggctgaagaagctgataagaaatatgatgaggtcgctcgtaaattggccatggttgaggctgatttggaaagagcagaagagagagccgagagcggtgaatcaaaaattgtagaacttgaggaagaactccgcgttgttggtaataacttgaaatcactggaagtgtcagaagaaaaggcaaaccagagagaagaagagtacaagaaccaaattaagacccttacaaacagacttaaggaggctgaagctcgcgctgaattcgccgagcgttccgttcagaaattgcagaaggaagttgacaggctggaggacgaacttgtccacgaaaaggagaagtaca

SEQ ID NO: 22 - DNA, 714 bp, artificial sequence
  Nezara viridula
ataagggactctccaaaggaggaaagaagggagttaagaagaaggtagttgaccctttcacaaggaaggattggtatgatgttaaggctccatcaatgtttaatacccgtcaaatcgggaagactcttgtcaacagaacacaaggaactaaaattgcttctgaaggactcaaaggtcgagttttcgaggtgagcttagccgatcttcagaatgatactgatgctgaaaggtcattcagaaaattccgtctcattgctgaagatgttcagggcagaaatgttttgaccaatttccatggtatggacttgaccacagataaactgaggagcatggtgaaaaagtggcaaacattaatcgaagccaatgttgatgttagaaccactgacggatacttgttgagagttttctgtattggattcactaacaaggaccagatgtctcagcgtaaaacttgttatgcccaacacaaccaggtcagagctattaggaaaaagatggttgacaatattacaaacaacattagtaacagcgatttgagggttgtggtcaacaaattgatccccgattccattgcaaaagacattgaaaaaatatgccaaggcatctatcctcttcatgatgtctacattaggaaggttaaggtactgaagaaaccaaggtttgagttgagcaaacttcttgaacttcatggtgatggtaaaggctctgatgaac

SEQ ID NO: 23 - DNA, 564 bp, artificial sequence
  Nezara viridula
ctcggtgttatcgttactgtaaaaataaaccttaccctaagtcaaggttttgtcgtggtgtgccagatcccaagatcaggatttttgatcttggaaagaaaaaggctcgtgttgatgattttccattatgtgtacatcttgtttctgatgaatatgaacaactttcatcagaagctcttgaagcaggacgtatctgtgcaaataaatatttagtaaaaaattgtggaaaagatcaattccacatcagaatgagattgcatcccttccatgtcatcaggataaacaaaatgttatcgtgtgctggagctgataggctccagactgggatgagaggtgcttttggaaaaccgcagggtactgtagctagagtacacatcggtcaacctatcatgagtgtccgttccagtgacagatacaaggctgctgtcattgaggcactcaggagagccaagttcaagtttccaggaaggcagaagatctatgtttctaagaaatggggtttcaccaagtatgaccgagagacatttgaggaactgagggctgatggaaaattggcgaatgatg

SEQ ID NO: 24 - DNA, 649 bp, artificial sequence
  Nezara viridula
agagccgaattgaatgagtttttaaccagagaactagctgaagaaggttattctggtgttgaggtccgtgaaactcctagcaggactgaaattattattatggccaccagaactcaaagtgttctaggagaaaaaggaaggcgtattagagaattaacttcagttgtgcaaaagagatttaactttcagccacaatctttagatttatatgctgaaaaagtcccaactagaggtttatgtgctattgctcaagctgaatctttgaggtacaagttgatagggggtctggctgtccgtagagcttgttatggagttctgagattcatcatggaaaatggagccaaagggtgtgaagtagtagtttcaggaaaacttagaggccaaagagctaagtccatgaaatttgttgatggccttatgatccacagtggtgacccatgtaatgaatatgtaaattcagctacccgccatgtattattgagacaaggagtacttggtatcaaagttaaaattatgttaccatgggatccaacaggaaagaatggacctaagaatcctctgcctgacaacgtttgtgttgtcaatcctaaagatgaaattattccttctgatattaagactatgggaatcgaattacatccaccagcta

SEQ ID NO: 25 - DNA, 282 bp, artificial sequence
  Nezara viridula
caaggcagaattagcttgtgtatactctgcactcatcctcgccgatgacgatgttgccgtaactggagagaaaatccaaaccatcctcaaagcagccagcgttgacattgagccctactggcctggcctcttcgccaaagcccttgaaggtatcaacgtcaaggacctcatcaccaacatcagcagtggtgtaggtgttggcggtggtgctccagcagctgctgcaggcggtgctgcacccgctgctgctgctgctccagccggtggtgacaagaagaaaga

SEQ ID NO: 26 - DNA, 584 bp, artificial sequence
  Nezara viridula
agttttccttggcaaaaaggaagaaaaagcacccacagcttctgaagctatacaaaagcttcgcgaaactgaggatatgttaattaaaaagcaggactttttggaaaagaaaattgagtctgaattaggtcttgtgaagaaaaatggtactagtaatagaagagttgcaattcaagctcttaaaagaaaaaagaggtatgagaaacaattgcaacaaattgatggtaccttggctaccattgaaatgcaaagagaagctttagaaggtgctaatactaatacagctgtccttcagacaatgaagtttgctgctgatgcattaaaaaccgcccataaacacatggatgttgaccaagttcatgatatgatggatgaaattgctgagcaacaagatgtcgcaaaagaaatatcggaagctatttctagccctgtcgcttttggaaatgacattgatgaggaggaacttgaaaaagagctagaggaattagaacaagaagaattagacagagaacttcttggtacaggcccgactgcagatcaattacctgatgtccctgccactcaattacctgcaaaaccaaagc

SEQ ID NO: 27 - DNA, 365 bp, artificial sequence
  Nezara viridula
tatatcccagtctgctttgccatatcgtcgatcagttccaacttggttgaaactatcaccagaagatgtgaaagaacagattttcaaattaggaaaaaagggactcactccttcacaaataggtgtcattcttcgagattcccatggtgtagcccaagtacgatttgtcactggaaacaagattctccgaatcatgaaggctatgggactagctcctgatcttccagaagacctctattttctgatcaagaaggctgttgctatcagaaagcatcttgaaaggaacaggaaggacaaggactccaagttccgccttatcttggtagaatccaggattcacagacttgctcgttactacaaaacca

SEQ ID NO: 28 - DNA, 706 bp, artificial sequence
  Nezara viridula
atactaaaaccaagcaggcaacaatcttcttacatcgcatcaaggcttggacagatattcagaaggtatacaagtctaaaaggttccgtgctggtaaaggtaagatgcgtaataggaggcgcattcagcgtagaggacctctcattatctacggccaggatcaaggcctaactcgtgcttttcgtaacattcctggtgttgatcttatcaacgtttcacgattaaacttacttaaactggcacctggtggtcacgtgggtaggtttgtaatctggacccaatcagcttttgatcaacttaatgctctctatggcacatggaagaaaaaatcaactttgaaaaaggactacaacttgccaatgcccaagatggtgaatactgatctgtcccgactttttaagtctgaagaaatcaagagtgtcctcaaacctccaaggaagaccatagtcaggagggtaaggaaactgaacccattgaggaatacacgagcaatgctgaagctcaacccatttgctgctgttctgaagaggaaagctattttggctgacaggaaacttaagcttgagagggctattgagagatcaaagaaggaaggagttgagcttacccctcatcaaaagaggtatgttgctatgcttgagagaaggaaagctcagatcaaagccgccaaggctgctaagcctaaaaaggttaagaagcctaaggc

SEQ ID NO: 29 - DNA, 539 bp, artificial sequence
  Nezara viridula
ctactgggtagactttcagctattgtagctaaagctgctttgaatggaaacagggtcgttgttgttaggacggaacaaattaatatttcaggaaacttcttcaggagtaaactaaagtacttatcgtttttaagaaaaagatgtaatgttaatccagccagaggtcctttccacttccgggcacccagtaaaattttgtatagaaccatcaggggtatggtgccacacaaaattgaaaggggaaaggctgctttaaggcgtatcaagttgtttgagggaatccctcccccatatgacaaaaggaagcgagtagtagtcccaacagccatgagagttttgtgcttaaaacctggtagggcttattgccatcttggcaggttatcttctgaagttggctggaagtacaaggatgtggtcagggcccttgaaaccaagaggaaggtcagggcagtttttgatattcgcaagaggaattccctcaagaaattgactaaacaagccaaggaaaagatgtccaaagcgaatgctaattataccgc

SEQ ID NO: 30 - DNA, 703 bp, artificial sequence
  Nezara viridula
aggataaactgcaacgtcttgttaaacacccgcaaacaaccggctggtccggcggtagcgtccacaccgctgcggcgtcgcccggccatagcaggcaaggcaggagccctggttataactccgcagcccacatgtgggactctgcgtcatccgatcccgtactctcggacatcctcgatcaagtcatcgagatagtaccagatgttaacacagatgcgccagctctgatgaatatgatcaactcgttggaagctgagactcagcagtctgttcaacaacagttcgtatctcaaacagatttgaatgaaaagatggcgattagcgctatacaaaagtctttaatgctctgcgaatcggcggttaaagggccttcttatcaaggaacgatgtcgcagggttctccaggaccacaaccccagcctcaacagcaaccacaaccacaacagcaacctcagccgcagcagcaacaatttcaccctcctccgatgtatcagcaaaggcagaggtttcctatccagcagcaacaacagattcgaagccagttccccctcagtccaatgattatggctcagaggagtaaaatgcaacagcagcagcagatgcaacaaaagcagcgattactccacatgcagcaacaacaacagcttgttattccgtcgaatgcgactgcctcaaataatgaccccgcactccataatattga

SEQ ID NO: 31 - DNA, 313 bp, artificial sequence
  Nezara viridula
ggtgctgagtggtagatatgctggaagaaaagcaattgtgcttaaaacttgtgatgaaggaactcaagagaaggcatatgggcatgcaataattgcaggcattgatcgctatccccgcaaagttcataagagaatgagcaaaacaaaaatccacaagaggtctaagatcaagcctttcttgaaggttatgaactacaaccaccttatgcccactcgttacacagtatctgagatcgcccctgaccagaaggttgttacgaaagatttgaaggacccaatgaagaagaagaaaatacgtttccaagttagggtg

SEQ ID NO: 32 - DNA, 412 bp, artificial sequence
  Nezara viridula
gcttactagagctgctaaggtattggaacaacttacaggacaacaacctgtattatcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaagtataggtatttacggtcttgacttttacgtagtattaggaagacccggattcaacgtagcccacaggaggtcaaagactggtaaagttggattctcacacagattgacaaaagaggatgccatgaagtggttccaacagaaa

SEQ ID NO: 33 - DNA, 728 bp, artificial sequence
  Nezara viridula
aacaagaacttaccgatgctcacgaacaaatcaacgaactcgcagctcaagccacaagcgcttctgctgccaagcgcaagctcgaaggagagttgcagacactccatgccgacctcgacgaacttctcaacgaagccaagaactcagaagagaaggctaagaaggctatggttgatgctgcgaggttagcagatgaactcagagctgaacaagaccacgcccagacccaagagaaactccgaaaggccctcgagacacagatcaaggaactccaagtcagactggacgaagccgaaaacaacgccctcaagggaggcaagaaggccattgccaagttggaacagagagtcagggaactcgaaaacgagcttgatggagaacagaggagacacgctgacgcccagaagaacctccgcaaatctgagcgcaggattaaggagctcagcttccaatctgatgaagataggaagaaccacgaacgcatgcaagaccttgtagacaaactccaacagaagatcaagacttacaagaggcagattgaagaagccgaagaaatcgctgccttgaacctcgccaaattccgcaaagcccaacaggaacttgaagaagctgaggagagagcagaccttgccgaacaggctgttacaaagctgagaacgaaaactggcggcagagctggatcaactgcaagagccatgagcccagtgggccagaaacaaaggagagta

SEQ ID NO: 34 - DNA, 688 bp, artificial sequence
  Nezara viridula
ggaactgggtatgatctgtcagcgtcacagttttctcctgatggtagagtttttcaagttgaatatgcacaaaaagctattgaaaatagtgggactgtcataggtctgcgaggcaaagatggtgttgttttagctgttgaaaagttggtcacatcaaaattatatgaaccgggtgccaataaaagactttttactattgacaaacacattggaatggctgtagcaggtctgatttctgatgctagggcagttgcagaagttgcaaggacggaagctgctaattacagatctcaatacaagagcagtatacctcttaaatacttgaatgagcgagtgtctatgtatatgcatgcttatacactctacagtgctgtaaggccatttgggtgcagcgttatactcagcacttacacagaagaagacggtccagaaatgtatatgatagatccatcaggagtttcatatggttattttggttgtgctgttgggaaggcgaagcaagctgcaaaaactgaaattgaaaaattaaaactgaaagatatgtcatgtcaggagctggtgaaggaagcagcccgaattatttaccttgtccatgacgaattaaaggacaaacagttcgagctggagatgagctggattggctctcagacaagtggtgtaaatcaacaagtccctgctaatgttcatg

SEQ ID NO: 35 - DNA, 712 bp, artificial sequence
  Nezara viridula
cctcagcgtaggaattacaatcttggttccggagtttacaggtttagcagaactcgcatgtttcataagaaggccttgtggaaatttattggtaagaaaacccctaagaccccacgtcccaaaaggaaaactactcttgaaaaaaaaattggtggtgagaagaatggaggtactcgtactgtctatttaaagaagaggacaaaatcttatcctaccactaacaaggtgagaaaacacccaagcaaaacatatttttctcagcacaagagacgattccgtgcatcactaaaacccggtgctattgtgattctgcttgctggactgcacaaaggaaaaagggcagtacttttaaaaaatatggctagtggacttctccttgtttctggtccattctctttgaatggagtacctcttagaagaatacatcccaactatgttatagccagttcaactcaaattgatctgtctggtgttaaattgcctgagcatatgaatgataggtacttcaagagagttaaagcaaaaaaggccaagaaaactgatggtgaaatctttgctgctaaaaaagaaatctacaaaccatccgaacagaggaagaccgaccagaaagaggtagacaaacagattttgcaggctattaagaaacatgaacatagtctacttctaaggaagtacctgtgcacaatgtttggccttcgaagcagtcagtatc

SEQ ID NO: 36 - DNA, 715 bp, artificial sequence
  Nezara viridula
ccaaagacaaattgcccattttcccttctcgaggtgctcagactttgatgaaaggaagacttgtgggtgcacaaaaaggtcacagtttgttaaagaaaaaagcagatgccctgcaaattaggtttaggatgatcctcagcaaaattattgagacaaaaactctgatgggagaagtgatgaaagaagcagctttttcattggctgaagcaaagttcgctactggagattttaaccaacaagttttacaaaatgtacagaaagctcaaataaaaattagaacaaagaaggataatgttgcaggtgtgacactgcccgttttcgagagctatcaagatggaacagattcctatgagctggctggattggctagaggaggacaacagttagcgaaactaaagaagaattatcaaaaggcgataaaacttctcgtagagctcgcttcattacaaacatcttttgttacgctagatgaagttatcaagcttacgaacagaagagttaacgctattgaacacgttattatacccagaattgaacgcacacttcagtatatcatttccgaattggatgagttggaaagagaagaattctatagattaaaaaagattcaagataagaaacgtatcgctcgtcaaaaagctgaagcaaagaaagcagtggacgctgccgcagcaacgatggcgagcaacattctcgaagaaaacgatgaggacct

SEQ ID NO: 37 - DNA, 602 bp, artificial sequence
  Nezara viridula
tgatccctaatggccatttccataaggattggcaaagatttatcaagacctggtttaatcaacctgctcgcaagtatcgccgaagaataaagagggtcaagaaagctagggccttggctccaagaccagcaactttactgcgtcctgctgttaggtgccctactgtgcgataccacacaaaattgagggctggcagaggcttcacattagaagaaattaagagggttggattgtgccctggatttgcgagatctatcgggattgctgtcgatcacaggagaaggaacaagtcagtcgagtctttacaattaaatgtacaacgtctgaaggagtatcaagctaagctaatcttgttcccaaccaagaagagcaagaaggtgaagaagggagaggcttcggccgaagaacaagctttagctacccaggtatcttcacctgtgatgccgatcaagcaaactgttgtaaaatataaagccagaactattactcctgaggataagagcttctctgcttatggagctttaagaaaggcaagggctgatgtgagacttgttggaatcagagctaaaaggctaaaggaagcagctgataaccctgaaact

SEQ ID NO: 38 - DNA, 453 bp, artificial sequence
  Nezara viridula
gacaatgatggacacaggatattagcaaaatactatgatccaagtgtctttccaacttctaaggaacaaaagggatttgaaaagaatttgtttaacaagactcatcgagctaatgcagaaataattatgttggatggacttacatgtgtttataaatctaatgttgatttatttttctatgttatgggaagttcacatgaaaatgagttgatattgatgagtgtacttcaatgcctttatgattcaataagtcaaatattgagaaaaaatgttgaaaaacggactctcttagaaaatttagaaattgtaatgttagccatggatgaaatttgtgatggaggaataatattagaagctgatccaacgagtgttgttcaaggagtagctttgaggacagatgatatcccacttggtgaacaaactgttgctcaggttcttcagagtgcaaaggag

SEQ ID NO: 39 - DNA, 470 bp, artificial sequence
  Nezara viridula
cctgtttggcaaaaaggaaatgagaatactgatggttggtcttgatgctgctggaaaaaccactattttatataaacttaaattaggagaaattgtaaccacaatcccaactattggatttaatgttgaaactgttgaatataagaacataagtttcacagtctgggatgttggtggtcaagacaaaattcgacccttgtggcggcattattttcaaaatactcaggggctcatttttgttgtagacagtaatgatagggaacgtattggtgaagcgcgagaagaactgatgagaatgctggcagaagatgaattaagggatgcagttcttcttatttttgcaaataagcaggatctgccaaatgccatgaatgcagctgagataacagacaaactcggcctacactcattgcgcaatcgcaactggtacattcaagcgacgtgtgcgacctcaggcgatggtctatatg

SEQ ID NO: 40 - DNA, 307 bp, artificial sequence
  Nezara viridula
atcctaaagcctacccattggctgatgctaccctcactgctaagatattaaatgttgtgcagcaagctctgaactacaagcagttaaggaaaggtgccaatgaatctactaaaactttgaatcgaggattagcagagtttatagtgatggctgctgatgcagaaccactagaaatattattgcatttacctctattatgtgaagacaaaaatgtgccatatgtttttgtccgttccaagcaagctcttggaagagcgtgcggagtttctcgacctgttgtcgcttgttcagtgactgtcaatgaagg

SEQ ID NO: 41 - DNA, 768 bp, artificial sequence
  Nezara viridula
acttagctgattcagttgcacctactgatattgaagaagggatgagagtcggtgttgatagaaacaaatatcaaattcagatacctcttccaccaaaaatagatccaactgtaactatgatgcaggttgaggaaaaacccgatgtcacttacagcgatgttggtggttgcaatgaacaaattgaaaaattgagagaagtagttgagacacctttgttacagcctgaaaagtttgtgaatttaggaattgaaccaccaaaaggagttcttctttttggtcctcctggtacaggaaaaacactttgcgctagagcagttgctaatagaaccgatgcttgttttataagagtaattggttcagaacttgtccaaaaatatgttggagagggagcaagaatggtgcgtgagctctttgaaatggctagaagtaaaaaagcttgcctaattttttttgatgaaatagatgctattggtggagccaggtttgatgacggagctgggggtgataatgaagttcaaagaacaatgttagaacttatcaaccagcttgatggttttgatcccaggggtaacattaaggttttaatggcaacaaatagacctgacactttggaccctgccttgatgagacctggaaggctggacagaaaagtagagtttggactacctgatctggaaggtcgttctcatattttcaaaattcatgcacgctcaatgagtgtagagagagatattcgatttgagttacttgctagactctgtcccaata

SEQ ID NO: 42 - DNA, 383 bp, artificial sequence
  Nezara viridula
atttcacagcaccatctcatattagaaggaaattgatgtcttctcctctctccaaagaacttaggcagaaatacaatgtccgcaccatgcctgttaggaaagatgatgaagttcaagttgttagaggacattataaaggacagcaggtaggcaaagttattcaggtatacagaaagaagtttgttatttatatcgagagaattcaaagagagaaagccaatggtgccagtgtgtatgttggcatccacccttccaaaacggtcattgttaaactaaaaattgacaaagacaggaaagaaattttggatagaagatccagaggaagagctctagcccttggaaaagacaaaggaaagtacaccgatgagaacacagcaatggat

SEQ ID NO: 43 - DNA, 715 bp, artificial sequence
  Nezara viridula
gctgctggaactttaatcacactttcgaatgctcctactgcaataaaagctgctgcttcttgttacattgatttgataataaaggaaagtgataataatgttaaattaattgtattagatcgtcttatatctttaaaagaaattcctactcatgaacgggttcttcaagatttagttatggatatattacgtgtgctagccagtcctgacatggaagtaaagaaaaaagccttaagcctagcactggatctcactacttcacggtgtgttgaagaaatggttttaatgttaaaaaaagaagttgctaagacacataacttgacagaacatgaagatgctggaaaatatcgtcaacttcttgttagaactcttcattcctgttgcatgaagtttccagatgttgctgcttcagttataccagtattaatggaatttctctcagatacaagtgaactagcttcgtatgatgttcttatatttgtccgagaagcaattcataagtttgattctttaagggttttgatcatagagaaattattagaagcgtttccaaccataaaatctatgaaagttcatcgagctgctctttggatattgggtgaatatactacttcagttacagatattaaagaagtcatgaaacaaataaaacatgcccttggagagataccacttgtcgatgatgaaataaaaagagcttctggagagaaagttg

SEQ ID NO: 44 - DNA, 399 bp, artificial sequence
  Nezara viridula
ccttacaaaggcaagttgtgtgctattgtggatgtcattaaccagaccagggctttagttgatggtcctgaaactggagtaccaagatgtggtataagattaaatcaattacatcttacaaaatttagaattcgtttcccatatactggttcaacacgtgttgtacgaaaagcttggaaagatagcaacttagatgctaagtggaaggaaagtgtttgggccaaaaagttagaagcaaaaaaaataagagccaatatgaatgactttgacaggtttcgccttaataatgctaggagaaccaggagcaaaatcaccaccaatgcatttttgattctgaagaaacaagctaaaaaggctaaaaaaaccgaagtaaaatctaaagacaagaaaccagaagct

SEQ ID NO: 45 - DNA, 714 bp, artificial sequence
  Nezara viridula
aaggcccattacaaactaggcttcttgaaatgaatttaatttctgctcctcaggttgctgatgctatacttgggaaccaaatgtttacacactatgatagagcccatattgctcagctttgtgagaaggctggtctactccaaagagcattagaacattatacagatctttatgatataaaacgagctgttgttcacactcatcttcttggccctgattggctcgtgggttattttggtaccctttccgttgaagattctcttgagtgtctgaaagccatgttaacagcaaatattcgacagaatttaaatatatgtgttcagattgcaactaagtaccatgaacagctgacaaccaaggctttgatagatctttttgaatcattcaaaagttatgagggattgttttatttcctgggctcaatagttaatttcagtcaagatcaagaagttcattttaaatacattcaggcagcatgtaaaacaggacaaataaaagaagttgaacgaatttgccgtgaatctaattgctataatccagagagagtaaaaaattttttgaaggaagcaaaattgacagatcaattaccacttattattgtttgtgatcgatttgatttttgtcatgatttggttttatatttatacagaaataatttgcaaaagtatattgaaatttatgtacaaaaggtcaatccttctcgtttacctgttg

SEQ ID NO: 46 - DNA, 454 bp, artificial sequence
  Nezara viridula
agatcttcgtgaaaaccctcacgggtaagacaattacccttgaggttgagccttctgatactatcgaaaatgtcaaagctaaaattcaagataaggaaggcattcctcctgaccagcagcgtttgatttttgctggcaaacagttagaagatggccgtactctttctgattacaacatacaaaaggaatctaccttgcacttagtgcttaggcttaggggaggtgccaagaagcgtaagaagaagaattactccactccaaaaaaaatcaagcacaagaagaagaaggttaaactagctgtgcttaaatattataaggttgacgagaatggtaaaatcagcaggttgaggagggaatgcccctccgagcagtgcggtgctggcgtcttcatggctgccatggaggacaggcactactgtggaaagtgtgcctacacccttgtcttcaataagcc

SEQ ID NO: 47 - DNA, 497 bp, artificial sequence
  Nezara viridula
aggaattgaggataatcggcgagtatggactgagaaataaacgtgaagtatggagggtcaaatatactcttgctaaaatcaggaaagctgccagagaattgcttactcttgatgagaaggatcccaagaggttgtttgaaggaaatgcacttttgcgaagattagtaaggataggagtattagatgaggctaaaatgaaacttgattatgttttgggtctcaaagttgaagatttcttggaaagaagacttcagacacaggtttttaaactgggtcttgctaagtcaattcaccatgctagagttttgataagacaaaggcatataagagtgaggaagcaggttgtcaatatacccagcttcattgtgaggttagactcacaaaaacacattgacttctcattgaaatcaccattcggtggtggccgccctggtcgtgtaaagaggaagaattctcgtaagggaactactgctgctgctgcagaggaagatgaagat

SEQ ID NO: 48 - DNA, 716 bp, artificial sequence
  Nezara viridula
accctattgcaacaaggatttaaacctcctactgcccagaagactggtacaactattgttggaatcgtatacagagatggtgttatccttggagccgatacgagagcaacagaaggtagcacagttgctgataagaattgctccaaaatacatttccttgctgacaacatctattgctgtggtgctggtactgctgccgacactgaaatgaccactatgacaataatgtcacaattggaattacatcgccttaatactgggcgcccagtcagagtttctactgccaagcagcttttgaaacaacttctcttcaggtatcaggggcacattggagcagctcttgtagttggtggtgttgacgtaaccggacctcttctttattctatacatcctcatggctcctctgagtgcttaccgtttacaactatgggctcgggatctcttgctgctatgacggtactcgaatcatcatggaagcccgatttgacggaagaagaaggtaaagtaattgtccgtaatgccattgctgctggtatattcaatgaccttggttctggaagcaacgtggacgtttgcatcatccgcaaaggttctgttgattatattcgcccctttgatatcgctaatctaaaaggacagaagcaaaataattatcgcttccgtcgaggcactacaggagttctttcaactagaataatccctttggtgacagaatc

SEQ ID NO: 49 - DNA, 631 bp, artificial sequence
  Nezara viridula
aaattgagtatgcacttgccgcagtcgcagctggagctccatcaatcggtatcagagcatccaatggagttgtattggctactgaaaacaaatacaaatcaattttatatgaagaacatactattcaaaaagtagaaatgataactaaacacattggaatggtctacagtggaatgggacctgattataggctactagtgaagagagctagaaaaatggctcaacaatatcagttagtttacggtgagcctattcctactgcacagcttgttcaacgagttgccatggttatgcaggagtacactcaatctggaggtgttagaccttttggagtttctttactcattgccgggtgggatggggataaaccatctctgtttcaatgtgatccatctggagcatactttgcctggaaagctactgcaatgggaaaaaattttgtcactggcaaaacatttctagaaaagaggtacagtgaaactttagagctggatgatgcagtacatactgcaattctcactcttaaagaaaactttgaaggccaaatgacttcggacaatatcgaggtcggagtttgtgatgatcaagggttcagagttttagatcctacaacagtgaaggattatctggc

SEQ ID NO: 50 - DNA, 701 bp, artificial sequence
  Nezara viridula
ccacttctgctaaaccatcagccaaacaacccgctccagctcctaaagccgctcagcccaaagcccaggcgaagcctgccgctcaacaacaaaagcctgctaaaccacagcagcaaacaaaaactgcagctccggctaaaggtcaagctaagcctgcagcccaggcaaagcccgctgctccagctgcagctcctaaacaacccgcagctccagctgcagcaggaactcaacctgccgcagcagcacccaagaaagctccttcaggtgcagttaaaaaagcaacaactgcgcccaaaaaaagtcaaaatttacagaagaagtcccaccaaggtgttaggaaacaagtgttaaaaggaaaaggacagaaaaagaaaaaagtatcattaaagtttataattgactgtactcatccatatgaagacaaaattatggacgtcgccaacttcgaaaagtatattcaagaaaggtttaaagttaatggtaaaaccaacaacttaggcaataatgttactttggaaaggaacaagatgaaaataactgttacttcagatgttcatttccctaagaggtacttgaaatatttgactaagaggtaccttaagaagaacaatttgagggattggctcagggttgtatctagttcgaaggatacctatgaactaaggtacttccagtttaatagccaggatgatgatgatgaa

SEQ ID NO: 51 - DNA, 252 bp, artificial sequence
  Nezara viridula
tggaggaagatccaaacatggtaggggtcacgtgcaagcagtccgttgcaccaactgtgcccgttgcgtgccaaaagataaggctatcaagaaattcgttattcgtaatatcgtagaagctgcagctgtgagggatatcacagatgctagcgtttactcttcgtaccagttgccgaagctctatgccaaactacattattgtgtgtcatgtgctatccactctaaagtagtgcgtaatcgttctaaggctga

SEQ ID NO: 52 - DNA, 779 bp, artificial sequence
  Nezara viridula
gaggcgacaactaggtaaaactgactattatgccaggaaaaggttgattgttcaagataaaaataagtacaatacaccaaaatatcgtttaatcgtccgtttttccaacaaagacatcacttgtcaggttgcttattcacgcattgaaggtgacaaaatattgtgtgctgcatacagccatgaacttcctcattttggaattaaagtaggattaactaactatgctgctgcctactgcactggtcttcttttggctaggaggttacttcagaaattgaagttggatgcactatatgaaggtacaactgaagtaactggtgatgaatacaatgtagagaacttggatgaaggcccaggagctttccgttgttatttggatgttggtttaatgaagaccagtgctggagcccgagtttttggggcattgaaaggtgctgttgatggaggtctcaacatccctcacagcatgaaaagatttcctggttatgattctgaaagtaaggagttcaatgctgaagttcaccgaaaacatatttttggaattcacgttgctgattacatgaggcagttggccgaatctgatgaagatgcttacaagaaacagttcagcatttacatcaaaaatgggattgttcctgatgctattgaagacatttataagaaggcacatgcagcaatcagagaaaatcctgctcatagaccacaagtaaggactaaggaagccatcaagaagagatggaatcgtgctaaacttacccttgccgaaaggaagaattgta

SEQ ID NO: 53 - DNA, 512 bp, artificial sequence
  Nezara viridula
gactttaacagggaagaccatcaccttagaagttgaaccatctgatactattgagaacgtaaaagcaaaaatccaggacaaagaaggaattccaccagaccagcaacgtttgatctttgctggaaaacaacttgaagatggccgtaccctttcagattataatattcaaaaagagtctactcttcatcttgtacttcgcttgagaggtggcatgcagatttttgttaagacgcttactggaaaaaccataactttagaagttgaaccgtcagataccattgaaaatgtaaaagccaaaattcaagataaagaaggaataccaccagaccaacagaggcttatttttgctggaaagcagctggaagatggccgaactttgtctgattacaacattcaaaaggaatcaacactgcatttggtgcttcgtctaagaggaggcatgcagatctttgtgaagactttgacaggtaaaaccattaccttggaagtagagccatctgatacaattgaga

SEQ ID NO: 54 - DNA, 467 bp, artificial sequence
  Nezara viridula
tgaggcgaagaaagctaaacaggccgagatcgagcggaagagagcagaggtccgaaagaggatggaggaggcctcaagaggcaagaaggccaagaaaggtttcatgacgccagacaggaagaagaaactccgacttctgctgaggaagaaagctgctgaggaactgaaaaaagaacaagaaaggaaagcagctgagagaaggaggatcattgaggagcgctgtggaaagatatgtgatgttgacaatgccaatgaagagaccctgaagaaaatctgccaagactatcacaagcggattgatgctttggaacgcagtaaaattgacatcgagtttgaagtggagaggagggattttgagattgcggatcttaacagccaagtcaatgatcttcgtggaaaattcgtaaagcccaccttaaaaaaggtttccaaatacgaaaataaatttgccaaacttcagaagaagg

SEQ ID NO: 55 - DNA, 43 bp, artificial sequence
  Nezara viridula
gcgtaatacgactcactatagggtgaaatggctgttggtctta

SEQ ID NO: 56 - DNA, 43 bp, artificial sequence
  Nezara viridula
gcgtaatacgactcactatagggtgttgctaagttcttccctc

SEQ ID NO: 57 - DNA, 43 bp, artificial sequence
  Nezara viridula
gcgtaatacgactcactataggggacgcagatgtacaaaaaca

SEQ ID NO: 58 - DNA, 43 bp, artificial sequence
  Nezara viridula
gcgtaatacgactcactatagggcgaccgaataaggatgttct

SEQ ID NO: 59 - DNA, 43 bp, artificial sequence
  Nezara viridula
gcgtaatacgactcactatagggactcaagggattcagcaatt

SEQ ID NO: 60 - DNA, 43 bp, artificial sequence
  Nezara viridula
gcgtaatacgactcactataggggcatctctggtctgatatcg

SEQ ID NO: 61 - DNA, 43 bp, artificial sequence
  Nezara viridula
gcgtaatacgactcactataggggaaagaccaactgagcagta

SEQ ID NO: 62 - DNA, 43 bp, artificial sequence
  Nezara viridula
gcgtaatacgactcactatagggttggctttcttctttgcttg

SEQ ID NO: 63 - DNA, 43 bp, artificial sequence
  Nezara viridula
gcgtaatacgactcactatagggcctcacgggtaaaaccatta

SEQ ID NO: 64 - DNA, 43 bp, artificial sequence
  Nezara viridula
gcgtaatacgactcactatagggggatattgttggtatgccca

SEQ ID NO: 65 - DNA, 43 bp, artificial sequence
  Nezara viridula
gcgtaatacgactcactataggggaaccaaacagagaaaaggc

SEQ ID NO: 66 - DNA, 43 bp, artificial sequence
  Nezara viridula
gcgtaatacgactcactataggggacctccgatagcatcaatt

SEQ ID NO: 67 - DNA, 43 bp, artificial sequence
  Nezara viridula
gcgtaatacgactcactatagggagtgcgttctttggtagatt

SEQ ID NO: 68 - DNA, 43 bp, artificial sequence
  Nezara viridula
gcgtaatacgactcactataggggagctcgtacaattggatct

SEQ ID NO: 69 - DNA, 43 bp, artificial sequence
  Nezara viridula
gcgtaatacgactcactataggggtgatttgttttcacgtggt

SEQ ID NO: 70 - DNA, 43 bp, artificial sequence
  Nezara viridula
gcgtaatacgactcactatagggcataaggtataggagcgagc

SEQ ID NO: 71 - DNA, 43 bp, artificial sequence
  Nezara viridula
gcgtaatacgactcactatagggactggtctccatgttgtttt

SEQ ID NO: 72 - DNA, 43 bp, artificial sequence
  Nezara viridula
gcgtaatacgactcactatagggtcatcttccctctggtaaga

SEQ ID NO: 73 - DNA, 43 bp, artificial sequence
  Nezara viridula
gcgtaatacgactcactataggggagtatcgaggaagctcttc

SEQ ID NO: 74 - DNA, 43 bp, artificial sequence
  Nezara viridula
gcgtaatacgactcactatagggccttggtctgtgagtatctg

SEQ ID NO: 75 - DNA, 43 bp, artificial sequence
  Nezara viridula
gcgtaatacgactcactatagggcccaattgaacacggtattg

SEQ ID NO: 76 - DNA, 43 bp, artificial sequence
  Nezara viridula
gcgtaatacgactcactataggggcatcctatcagcaatacca

SEQ ID NO: 77 - DNA, 43 bp, artificial sequence
  Nezara viridula
gcgtaatacgactcactatagggacatggaaaagatctggcat

SEQ ID NO: 78 - DNA, 43 bp, artificial sequence
  Nezara viridula
gcgtaatacgactcactatagggggagcgatgatcttgatctt

SEQ ID NO: 79 - DNA, 43 bp, artificial sequence
  Nezara viridula
gcgtaatacgactcactatagggatcatcaacgtacactagcc

SEQ ID NO: 80 - DNA, 43 bp, artificial sequence
  Nezara viridula
gcgtaatacgactcactatagggagcagaagatgtcgaaaact

SEQ ID NO: 81 - DNA, 43 bp, artificial sequence
  Nezara viridula
gcgtaatacgactcactataggggtgttaggggtcatgatgtt

SEQ ID NO: 82 - DNA, 43 bp, artificial sequence
  Nezara viridula
gcgtaatacgactcactatagggttccatatcaccgtgcatag

SEQ ID NO: 83 - DNA, 44 bp, artificial sequence
  Nezara viridula
gcgtaatacgactcactataggggcgtttaaatgctccaaaatc

SEQ ID NO: 84 - DNA, 43 bp, artificial sequence
  Nezara viridula
gcgtaatacgactcactatagggacccttgcctttaggtaatg

SEQ ID NO: 85 - DNA, 43 bp, artificial sequence
  Nezara viridula
gcgtaatacgactcactatagggattgttatggctgctaccaa

SEQ ID NO: 86 - DNA, 43 bp, artificial sequence
  Nezara viridula
gcgtaatacgactcactatagggaaaaagaacacatggtgcag

SEQ ID NO: 87 - DNA, 43 bp, artificial sequence
  Nezara viridula
gcgtaatacgactcactatagggactattgaagacgaatcggg

SEQ ID NO: 88 - DNA, 43 bp, artificial sequence
  Nezara viridula
gcgtaatacgactcactatagggataactacacaagagcaccc

SEQ ID NO: 89 - DNA, 43 bp, artificial sequence
  Nezara viridula
gcgtaatacgactcactatagggatagcagaaggatgtctgga

SEQ ID NO: 90 - DNA, 43 bp, artificial sequence
  Nezara viridula
gcgtaatacgactcactatagggctcttctctgtcttcttcgg

SEQ ID NO: 91 - DNA, 43 bp, artificial sequence
  Nezara viridula
gcgtaatacgactcactatagggctcacagtgtatcagctacc

SEQ ID NO: 92 - DNA, 43 bp, artificial sequence
  Nezara viridula
gcgtaatacgactcactataggggccctaggtaaaacacaaga

SEQ ID NO: 93 - DNA, 43 bp, artificial sequence
  Nezara viridula
gcgtaatacgactcactatagggagcctcaaaagaagactgag

SEQ ID NO: 94 - DNA, 43 bp, artificial sequence
  Nezara viridula
gcgtaatacgactcactataggggatatttgccagtcaaagcc

SEQ ID NO: 95 - DNA, 43 bp, artificial sequence
  Nezara viridula
gcgtaatacgactcactatagggtcaagaagaagatgcaagct

SEQ ID NO: 96 - DNA, 43 bp, artificial sequence
  Nezara viridula
gcgtaatacgactcactatagggtgtacttctccttttcgtgg

SEQ ID NO: 97 - DNA, 43 bp, artificial sequence
  Nezara viridula
gcgtaatacgactcactatagggataagggactctccaaagga

SEQ ID NO: 98 - DNA, 43 bp, artificial sequence
  Nezara viridula
gcgtaatacgactcactataggggttcatcagagcctttacca

SEQ ID NO: 99 - DNA, 43 bp, artificial sequence
  Nezara viridula
gcgtaatacgactcactatagggctcggtgttatcgttactgt

SEQ ID NO: 100 - DNA, 43 bp, artificial sequence
  Nezara viridula
gcgtaatacgactcactatagggcatcattcgccaattttcca

SEQ ID NO: 101 - DNA, 43 bp, artificial sequence
  Nezara viridula
gcgtaatacgactcactatagggagagccgaattgaatgagtt

SEQ ID NO: 102 - DNA, 43 bp, artificial sequence
  Nezara viridula
gcgtaatacgactcactatagggtagctggtggatgtaattcg

SEQ ID NO: 103 - DNA, 43 bp, artificial sequence
  Nezara viridula
gcgtaatacgactcactatagggcaaggcagaattagcttgtg

SEQ ID NO: 104 - DNA, 43 bp, artificial sequence
  Nezara viridula
gcgtaatacgactcactatagggtctttcttcttgtcaccacc

SEQ ID NO: 105 - DNA, 43 bp, artificial sequence
  Nezara viridula
gcgtaatacgactcactatagggagttttccttggcaaaaagg

SEQ ID NO: 106 - DNA, 43 bp, artificial sequence
  Nezara viridula
gcgtaatacgactcactataggggctttggttttgcaggtaat

SEQ ID NO: 107 - DNA, 43 bp, artificial sequence
  Nezara viridula
gcgtaatacgactcactatagggtatatcccagtctgctttgc

SEQ ID NO: 108 - DNA, 43 bp, artificial sequence
  Nezara viridula
gcgtaatacgactcactatagggtggttttgtagtaacgagca

SEQ ID NO: 109 - DNA, 43 bp, artificial sequence
  Nezara viridula
gcgtaatacgactcactatagggatactaaaaccaagcaggca

SEQ ID NO: 110 - DNA, 43 bp, artificial sequence
  Nezara viridula
gcgtaatacgactcactataggggccttaggcttcttaacctt

SEQ ID NO: 111 - DNA, 43 bp, artificial sequence
  Nezara viridula
gcgtaatacgactcactatagggctactgggtagactttcagc

SEQ ID NO: 112 - DNA, 43 bp, artificial sequence
  Nezara viridula
gcgtaatacgactcactataggggcggtataattagcattcgc

SEQ ID NO: 113 - DNA, 43 bp, artificial sequence
  Nezara viridula
gcgtaatacgactcactatagggaggataaactgcaacgtctt

SEQ ID NO: 114 - DNA, 43 bp, artificial sequence
  Nezara viridula
gcgtaatacgactcactatagggtcaatattatggagtgcggg

SEQ ID NO: 115 - DNA, 43 bp, artificial sequence
  Nezara viridula
gcgtaatacgactcactatagggggtgctgagtggtagatatg

SEQ ID NO: 116 - DNA, 43 bp, artificial sequence
  Nezara viridula
gcgtaatacgactcactatagggcaccctaacttggaaacgta

SEQ ID NO: 117 - DNA, 43 bp, artificial sequence
  Nezara viridula
gcgtaatacgactcactataggggcttactagagctgctaagg

SEQ ID NO: 118 - DNA, 43 bp, artificial sequence
  Nezara viridula
gcgtaatacgactcactatagggtttctgttggaaccacttca

SEQ ID NO: 119 - DNA, 43 bp, artificial sequence
  Nezara viridula
gcgtaatacgactcactatagggaacaagaacttaccgatgct

SEQ ID NO: 120 - DNA, 43 bp, artificial sequence
  Nezara viridula
gcgtaatacgactcactatagggtactctcctttgtttctggc

SEQ ID NO: 121 - DNA, 43 bp, artificial sequence
  Nezara viridula
gcgtaatacgactcactatagggggaactgggtatgatctgtc

SEQ ID NO: 122 - DNA, 43 bp, artificial sequence
  Nezara viridula
gcgtaatacgactcactatagggcatgaacattagcagggact

SEQ ID NO: 123 - DNA, 43 bp, artificial sequence
  Nezara viridula
gcgtaatacgactcactatagggcctcagcgtaggaattacaa

SEQ ID NO: 124 - DNA, 43 bp, artificial sequence
  Nezara viridula
gcgtaatacgactcactataggggatactgactgcttcgaagg

SEQ ID NO: 125 - DNA, 43 bp, artificial sequence
  Nezara viridula
gcgtaatacgactcactatagggccaaagacaaattgcccatt

SEQ ID NO: 126 - DNA, 43 bp, artificial sequence
  Nezara viridula
gcgtaatacgactcactatagggaggtcctcatcgttttcttc

SEQ ID NO: 127 - DNA, 43 bp, artificial sequence
  Nezara viridula
gcgtaatacgactcactatagggtgatccctaatggccatttc

SEQ ID NO: 128 - DNA, 43 bp, artificial sequence
  Nezara viridula
gcgtaatacgactcactatagggagtttcagggttatcagctg

SEQ ID NO: 129 - DNA, 43 bp, artificial sequence
  Nezara viridula
gcgtaatacgactcactataggggacaatgatggacacaggat

SEQ ID NO: 130 - DNA, 43 bp, artificial sequence
  Nezara viridula
gcgtaatacgactcactatagggctcctttgcactctgaagaa

SEQ ID NO: 131 - DNA, 43 bp, artificial sequence
  Nezara viridula
gcgtaatacgactcactatagggcctgtttggcaaaaaggaaa

SEQ ID NO: 132 - DNA, 43 bp, artificial sequence
  Nezara viridula
gcgtaatacgactcactatagggcatatagaccatcgcctgag

SEQ ID NO: 133 - DNA, 43 bp, artificial sequence
  Nezara viridula
gcgtaatacgactcactatagggatcctaaagcctacccattg

SEQ ID NO: 134 - DNA, 43 bp, artificial sequence
  Nezara viridula
gcgtaatacgactcactatagggccttcattgacagtcactga

SEQ ID NO: 135 - DNA, 43 bp, artificial sequence
  Nezara viridula
gcgtaatacgactcactatagggacttagctgattcagttgca

SEQ ID NO: 136 - DNA, 43 bp, artificial sequence
  Nezara viridula
gcgtaatacgactcactatagggtattgggacagagtctagca

SEQ ID NO: 137 - DNA, 43 bp, artificial sequence
  Nezara viridula
gcgtaatacgactcactatagggatttcacagcaccatctcat

SEQ ID NO: 138 - DNA, 43 bp, artificial sequence
  Nezara viridula
gcgtaatacgactcactatagggatccattgctgtgttctcat

SEQ ID NO: 139 - DNA, 43 bp, artificial sequence
  Nezara viridula
gcgtaatacgactcactataggggctgctggaactttaatcac

SEQ ID NO: 140 - DNA, 43 bp, artificial sequence
  Nezara viridula
gcgtaatacgactcactatagggcaactttctctccagaagct

SEQ ID NO: 141 - DNA, 43 bp, artificial sequence
  Nezara viridula
gcgtaatacgactcactatagggccttacaaaggcaagttgtg

SEQ ID NO: 142 - DNA, 43 bp, artificial sequence
  Nezara viridula
gcgtaatacgactcactatagggagcttctggtttcttgtctt

SEQ ID NO: 143 - DNA, 43 bp, artificial sequence
  Nezara viridula
gcgtaatacgactcactatagggaaggcccattacaaactagg

SEQ ID NO: 144 - DNA, 43 bp, artificial sequence
  Nezara viridula
gcgtaatacgactcactatagggcaacaggtaaacgagaagga

SEQ ID NO: 145 - DNA, 43 bp, artificial sequence
  Nezara viridula
gcgtaatacgactcactatagggagatcttcgtgaaaaccctc

SEQ ID NO: 146 - DNA, 43 bp, artificial sequence
  Nezara viridula
gcgtaatacgactcactatagggggcttattgaagacaagggt

SEQ ID NO: 147 - DNA, 43 bp, artificial sequence
  Nezara viridula
gcgtaatacgactcactatagggaggaattgaggataatcggc

SEQ ID NO: 148 - DNA, 43 bp, artificial sequence
  Nezara viridula
gcgtaatacgactcactatagggatcttcatcttcctctgcag

SEQ ID NO: 149 - DNA, 43 bp, artificial sequence
  Nezara viridula
gcgtaatacgactcactatagggaccctattgcaacaaggatt

SEQ ID NO: 150 - DNA, 43 bp, artificial sequence
  Nezara viridula
gcgtaatacgactcactataggggattctgtcaccaaagggat

SEQ ID NO: 151 - DNA, 43 bp, artificial sequence
  Nezara viridula
gcgtaatacgactcactatagggaaattgagtatgcacttgcc

SEQ ID NO: 152 - DNA, 43 bp, artificial sequence
  Nezara viridula
gcgtaatacgactcactataggggccagataatccttcactgt

SEQ ID NO: 153 - DNA, 43 bp, artificial sequence
  Nezara viridula
gcgtaatacgactcactatagggccacttctgctaaaccatca

SEQ ID NO: 154 - DNA, 43 bp, artificial sequence
  Nezara viridula
gcgtaatacgactcactatagggttcatcatcatcatcctggc

SEQ ID NO: 155 - DNA, 43 bp, artificial sequence
  Nezara viridula
gcgtaatacgactcactatagggtggaggaagatccaaacatg

SEQ ID NO: 156 - DNA, 43 bp, artificial sequence
  Nezara viridula
gcgtaatacgactcactatagggtcagccttagaacgattacg

SEQ ID NO: 157 - DNA, 43 bp, artificial sequence
  Nezara viridula
gcgtaatacgactcactataggggaggcgacaactaggtaaaa

SEQ ID NO: 158 - DNA, 43 bp, artificial sequence
  Nezara viridula
gcgtaatacgactcactatagggtacaattcttcctttcggca

SEQ ID NO: 159 - DNA, 25 bp, artificial sequence
  Nezara viridula
gactttaacagggaagaccatcacc

SEQ ID NO: 160 - DNA, 25 bp, artificial sequence
  Nezara viridula
tctcaattgtatcagatggctctac

SEQ ID NO: 161 - DNA, 23 bp, artificial sequence
  Nezara viridula
tgaggcgaagaaagctaaacagg

SEQ ID NO: 162 - DNA, 28 bp, artificial sequence
  Nezara viridula
ccttcttctgaagtttggcaaatttatt

SEQ ID NO: 163 - DNA, 354 bp, artificial sequence
  Nezara viridula
atggcgcccaaggctcctaaatatgaaatggctgttggtcttaaaaaaggtcacaggacaaccaagattgtaatgggaaagtccaaagctgataagaagcacaaaattagaccatcacgcctgaaaggtagacaaaccaagcatacaaagtttgttagagatttgatcagagaagtatgcggtcatgcaccttatgaaaagagaggaatggagttgctcaagatttccaaggataagagggctttgaaatttttgaagagaaggatcggcactcacatccgtgctaagaggaagagggaagaacttagcaacattcttactcagatgcgtaaggcacatgcccaacaaaaataa

SEQ ID NO: 164 - DNA, 681 bp, artificial sequence
  Nezara viridula
atgtctcttagcgacgcagatgtacaaaaacaaatcaagcacatgatggccttcattgagcaggaggccaatgaaaaggctgaagaaattgatcaaaaagctgaagaagaattcaatattgagaaaggaaggcttgttcagaatcaaagattaaagatcatggaatattatgaaagaaaagaaaaacaggtggaacttcaaaagaaaatccaatcttcaaatatgttgaatcaagctcgactcaaagctttgaaaatacgtgaagatcatgttcgcgatgtactcgatgaggccaggaagagactgttgcaatcagtcaaagacgaagcacgttacaaagatatccttgagaaactcatgcttcaggggttgtaccagttgatggaatcagacattttggttagaactcgtgaaatggatggcccagttgtgagctcagtgttccctgatgtgctggtgaaatacaaggaatcatcaggtaaggatttgcagctgaagttggatacagaattgtacttaccatctgaatgtgctggtggcattgaactttacactgcgagaggccgtatcaagattgttaacactcttgaatccaggcttgatcttatttcagcacaattgttgcctcaaattagaacatccttattcggtcgtaatgtgaaccgtaaattcactgactaa

SEQ ID NO: 165 - DNA, 357 bp, artificial sequence
  Nezara viridula
atggccagtcagactcaagggattcagcaattattagcggctgagaaaagagctgctgaaaaagttgctgaggcgaaaaaacgcaaggctaggcgtctaaagcaagccaaagaagaggcccaagaagaaattgaaagatacaagcaagacagagagaaacagttcagggagtttgaagctcagcatatgggctcacgagaagatgttgcagcaaggatagatgctgatacacgccaaaagattgaagaaatgaatgaagcagttaatgctaacaaagaagcagttattcaaagaattttggaattggtttacgatatcagaccagagatgcataagaactacagagcaccaaactaa

SEQ ID NO: 166 - DNA, 1293 bp, artificial sequence
  Nezara viridula
atgtctacttctaaaacagaagaaaagcccatgtgggacgaaaggatggaacaagctttaagtgaagaaataatgagaatgtctactgatgaaattgtaagccgcattagacttcttgataatgaaattaaaataatgaaaagtgaagtaatgcgggtcagtcatgagctgcaagcacaaacagaaaaaataaaggaaaatacagagaagattaaagtaaacaaaactttaccatacttggtatcaaatgtgattgagttgcttgatgtagatccagaggaaactgaggaagatggtgctgttgtagatcttgacgctcgtcgaaaaggaaaatgtgccgttattaaaacatcaaccagacaaacttattttttgcctgttattggcttagttgatgcagaaaaattaaagccaggtgaccttgttggtgtgaataaagattcttatttgattcttgaaactttacctgcagaatatgatgcacgtgttaaagctatggaagttgacgaaagaccaactgagcagtattcagacattggtgggctagacaaacagattcaagagctaattgaagctgttgttcttcccatgacccacaaagaaaaatttgaaaatcttggaattcatcctcctaaaggtgtattactttatggacctcctggaacaggaaaaactttattggcaagagcgtgtgcagctcaaacaaaatctacttttctgaaacttgctggtccccagctagtacagatgttcattggggatggagccaaacttgttagagatgcttttgctcttgctaaagaaaaatctccagctattatatttattgatgagttggatgctattgggacaaaaagatttgattctgaaaaggctggtgatcgagaagttcaaagaactatgttagagttactcaaccagttagatggatttagttcaacagctgacataaaggttattgctgctacaaatagagtagatattttggatcctgcccttttgcgttctggacgactcgataggaaaattgaattcccacatcctaatgaagatgctagagcacgtataatgcaaatacattcccgtaaaatgaatattagtgtagatgtgaattttgaagaacttgctcgttcaaccgatgatttcaatggagctcagtgtaaagctgtttgtgtggaggctggtatgatagctttgcgtcgaggagctggagtagttacccatgaagatttcatggatgcaatattggaagtacaagcaaagaagaaagccaacttaaactattatgcttaa

SEQ ID NO: 167 - DNA, 387 bp, artificial sequence
  Nezara viridula
atgcagatcttcgttaagaccctcacgggtaaaaccattaccctagaggttgaaccttctgatactattgaaaatgtgaaagctaagattcaagacaaagagggaattcctccagatcagcagaggcttatttttgctggtaaacaattggaagatggaagaactttgtctgattacaacattcaaaaagaatctactcttcatttggtccttcgtctgaggggtggtgtcattgaaccaactctcaaaattcttgcacagaaatacaattgtgacaagatgatttgccgcaagtgctacgctaggcttcacccgagggcaactaactgccgcaagaagaaatgtgggcataccaacaatatccgccccaagaagaagctgaagtag

SEQ ID NO: 168 - DNA, 1188 bp, artificial sequence
  Nezara viridula
atgacggcttctcaagcaatggaaccaaacagagaaaaggctttacaagattatcgtaaaaaattactggagcataaagaagttgaagtcagacttaaagaaatgagagaccagttaaaagatcttaccaaacaatatgataaatctgaaaatgacttgaaagcccttcaaagtgttggtcagattgttggagaagtattaaagcagcttactgaagaaaaatttattgtcaaggctaccaatggtccaagatatgttgttggttgtagaagacaacttgataaattaaaacttaaatctggcacgagggtagcattggacatgacaactttaacaattatgcgacatttgccgagagaagttgatccattagtgtataacatgtctcatgaagatccaggagatgtaacatattctgctattggaggtcttgcagaacaaattagagaacttcgtgaggtgattgagctgcctctgttgaatcctgaactttttcaacgagttggtattactccacctaaaggatgtctactttacggccctcctggtactggaaagactttgttggccagagctgtagccagccaattagatgcaaacttccttaaggtagtctccagtgctatcgttgacaaatatattggagaaagtgctcgtctaattagagaaatgtttaattatgcaagagatcaccagccttgcataatttttatggatgaaattgatgctatcggaggtcgacgattctcagaaggaacatctgctgatcgtgaaatacaaagaactcttatggaacttcttaaccaaatggatggatttgattctctgggacaggttaaaatgatcatggccactaatcgtcccgataccttagaccctgctcttctccgtcctggcaggctagacaggaagattgaaattcctttgccaaatgaacaggcaaggctagaaatcctcaagatccatgctgggcctatttctaagcatggagatattgattatgaggctgtcgtgaagttgtctgataatttcaatggagctgacttgagaaatgtttgtactgaagctggcctttttgctattcgagctgaaagagaatatgtaatgcaggaagactttatgaaagctgtgagaaaagtggctgacaataagaaacttgagtcaaaactcgattacaaaccagtataa

SEQ ID NO: 169 - DNA, 1251 bp, artificial sequence
  Nezara viridula
atggcgggtgcaatgttgtttgagaggactgtctcttccagagatagggataatagtcgaattcttccaacttctagcagaaacgttgacgaagaaaatgaagaagacatcaaaaataaggaacaaggaattttgcagttgggagagcaatataagaaagaaggcaaagctaaagagttagcagagcttatcaaggcaagtagaccatttcttagccagattagtaaagctaaagctgcaaaattagtgcgttctttggtagattatttcttggatcttgaagctggaataggaatagaagttcaactttgtaaagagtgtatcgaatgggctaaagatgaacacaggacttttctcaggcagtcactggaagctaggcttatcgctctatatttcgacacaggaatgtttacagaagcactacagcttggctcaagtcttcttaaagaattaaagaaattagatgataaaaatttgcttgttgaagtccttttgttggaatctaaaacttatcatgctttgagcaacctttcaaaagccagggctgctttgacatcagccaggacaactgctaattccatatattgtccacccaaaatgcaagcagccctcgatttgcaatctggtatattacacgcagcagatgaacaagatttcaaaacagcttactcatatttctatgaagcttttgaaggctatgatagtgtagagagcccaaaggctttagttgctcttaaatatatgcttctgagtaaaatcatgttaaacacaccagaagacgtgcagcagttggttagcgggaaacttgctcttaaacatgctggtaaagatattgatgcaatgaaatcagttgctcaagccagccataagagatcacttgctgatttccagctaactttaaaaaattacaagaaagagcttgaggaagatccaattgtacgagctcacttgggtacactctatgataatatgttggaacaaaatttgtgtaggatcattgagccttattccagagctcaagtcgattttatttcaaaatcaattaaacttccccttcctcaagttgaaaagaagctttctcaaatgattcttgataagaagttcaatggtattcttgaccaaggtgagggagttcttatagtgttcgaagatgcgattgttgaaaaaacctacgaaatggccctggaagttattaacagcatgggtaaggttgtagacacattatatcaaaaagctaagaagctctcttaa

SEQ ID NO: 170 - DNA, 480 bp, artificial sequence
  Nezara viridula
atgacaaactccaagggttatcgccgaggtacccgtgatttgttttcacgtggttacaggaaacatggtgtcatcccactttcgacgtacatgaaagtatacaaagttggagatattgtatcgattaagggaaatggtgctgttcaaaagggtatgccccacaaaagttatcatgggaaaacaggacgagtttacaatgtaactcctagagctttgggtgtgatcgtcaacaaaagggtccgtggaaaaattctacctaagaggattaacatccgtattgaacatgtcaaccactccaagtgccgtgaagatttcttgaagcgtgtacgagaaaatgagaggctcaggaaagaggccaaagaaaagggcattcatgttgaattgagaagacagcctgcccagccacgacctgctcatttgataactgtcaaagagcctccaataatgctcgctcctataccttatgaatttattgcttaa

SEQ ID NO: 171 - DNA, 657 bp, artificial sequence
  Nezara viridula
gaagttccacactggtctccatgttgttttctttcagtgtggaacttcgggattaccatgagttcgttgaagttacagaagaggctagcagcctctgttatgagatgtggtaaaaaaaaggtttggttagacccaaatgaaattaatgaaatagccaatacaaattcaagacaaaacatcaggaagttaatcaaagatggttttattatcaagaaacccgttgcagtacattccagggcccgtgttcgtaaaaatactgaagccagaaggaaaggtaggcattgtggtttcggtacaaggaaaggtactgctaatgcaagaatgccagcgaaggtgttgtgggtgaacagaatgagggttcttaggcggttactgaagaagtatagagaagccaagaaaattgataggcagatgtatcatgacttatacatgaaagcaaaaggtaatgtttttaaaaacaagcgtgtattgatggaatttattcataagaagaaagctgaaaaagctaggtccaaaatgctccgtgatcaagctgaagccaggaggcaaaaagttaaagaagcaaagaagcggcgagaagaaaggatcacaatgaagaaacaagaaatattacaatcttaccagagggaagatgaagctgcatcagctaaaaaataa

SEQ ID NO: 172 - DNA, 690 bp, artificial sequence
  Nezara viridula
atacagtcggccttgagggagtatcgaggaagctcttcgttcacgttaccgtgtttctacaagccttcattcgcaatgggggcttacaagtacatccaggaattgtacagaaaaaagcagtcagatgccatgaggtatctgctgcgaatcagggtttggcaatacagacagatgaccaagatgcaccgtgttgtgaagccttcaagacccgataaagctaggagattgggatttaagaataaacaaggtttctgtgtattcaggatccgtatcaagcgaggaggcaggaaacgcccagttccaaagggtgctacctatggcaaacctaaaagccatggagtaaaccagttgaaacctacaagaagtctccatgctatggctgaggaaaaagttggtaggaagtgcagtggattgagagtattaaactcttattgggtagcccaagacgccagatacaaatactacgaagtcatctgcgttgacccagctcacaaggcaatcagaagagatgctaaagccaactggatatgtgacccagtgcacaagcaccgtgagatgcgtggtaagactagcgctgctaggaagtcacgaggtcttggcaagggccacagatactcacagaccaagggaggttccaggaaggccgcctgggtgagaaggaacaccttacagctgcgcagaaagcgataa

SEQ ID NO: 173 - DNA, 1131 bp, artificial sequence
  Nezara viridula
atgtgtgacgaagaagttgctgctttagttgtagacaatggatccggtatgtgcaaagccggttttgctggagatgatgcaccccgagcagtattcccatcaattgttggcaggccaaggcatcagggtgtcatggttggtatgggccaaaaggacagctatgttggagacgaagcccagagcaagagaggtatcttaaccttaaaatacccaattgaacacggtattgtaactaactgggatgatatggaaaaaatttggcatcacactttctacaatgaacttcgagttgcgccagaagagcacccagttctcctgactgaagcacctttgaaccccaaagcaaatagggaaaaaatgacacagatcatgtttgaaacattcaacactccagctatgtatgttgccattcaagctgttctgtccctgtatgcatctggacgtaccaccggtattgttctggattctggagatggtgtctcacacactgtaccaatttatgaaggttatgctctacctcatgccatccttaggttggatttagctggacgtgacctcactgattacctcatgaagatcctgactgaaaggggatactccttcacgactactgctgagagagaaattgtgagggatatcaaggaaaaattgtgttatgttgctcttgactttgagcaggaaatggccactgctgccagttcaagttccctagaaaaatcttatgaacttcctgatggacaagttatcacaattggaaatgaaaggttccgatgccctgaagctctgttccagccttctttcttgggtatggaggcatgtggtatccatgagaccacttacaactcaatcatgaaatgtgatgtcgacattaggaaggacttgtatgccaatactgttctctctggaggtactaccatgtaccctggtattgctgataggatgcaaaaggaaatcactgcccttgctccttctacaatgaaaattaagatcattgctccaccagaaaggaagtactcagtatggatcggtggatcaatccttgcctccctttctaccttccagcaaatgtggatttctaagcaggaatatgacgaatctggcccatctattgttcacaggaaatgtttctaa

SEQ ID NO: 174 - DNA, 1131 bp, artificial sequence
  Nezara viridula
atgtgtgacgacgatgttgctgccctcgtagttgacaatggttccgggatgtgcaaggccggtttcgccggagacgacgccccgagggccgtcttcccatccatcgtcggaagacccaggcaccagggtgtcatggttggtatgggccaaaaggacagctacgtaggagatgaagcccaaagcaaaagaggtatcctcaccctgaagtaccccattgaacacggtatcatcacaaactgggacgacatggaaaagatctggcatcacaccttctacaacgagctgcgagtcgctccagaggaacaccccatcctcctcaccgaggctcccctcaaccctaaagccaacagggagaagatgacccagatcatgtttgagaccttcaacaccccagccatgtatgtcgccatccaggctgtactctccctctatgcctccggtcgtaccaccggtattgtacttgactcaggagatggtgtatcccacaccgtacccatctatgaaggttatgcccttcctcacgccatcctccgtctggatcttgctggacgtgacttgactgactaccttatgaagatcctcaccgaacgtggttacagtttcacaaccaccgctgaaagggaaatcgtcagggacatcaaggaaaaactgtgctatgttgccctggactttgaacaggaaatggccaccgctgctgcctccacctccctcgagaagtcttatgaacttcctgacggtcaggtcatcaccatcggtaacgagaggttccgttgcccagaggctctcttccagccttccttcttgggtatggaatcttgcggtatccatgagactgtctacaactccatcatgaagtgcgatgttgacatcaggaaggacttgtacgccaacaccgtcctctccggaggtaccaccatgtacccaggtattgctgacaggatgcagaaggaaatcaccgccctcgctccttcaaccatcaagatcaagatcatcgctcccccagaaaggaagtactccgtatggatcggtggttccatcttggcttccctgtccaccttccagcagatgtggatctccaagcaggaatacgacgaatccggcccaggcatcgtccaccgcaaatgcttctaa

SEQ ID NO: 175 - DNA, 1518 bp, artificial sequence
  Nezara viridula
atggtgctaatcgcagcagcggtttgcacaaaagctggtaaaaccattgtttcaaggcagtttgttgaaatgactaaggcccgcattgaaggattgctagcagcatttccaaaattgatgtcatcgggtaaacagcatacatttgttgaaactgattcagtgcgatatgtgtatcagccgcttgagaaactttacatggtgctgattactactaaggcctcaaatattttagaagatcttgaaacattaagactattttctcgtgtgatccctgagtattgccgcaatatggaagagtcagaaattactgaaaatgcatttaatctgattttcgcatttgatgaaattgtggctcttggttacagggaaagtgttaacttagctcagattaggacttatgttgaaatggattctcatgaagagaaagtatacatggctgtaagacagtctcaagagagagaagctaaaaataaaatgagggaaaaggccaaagagctgcagagacaaaggttagaagctggaaagaaaggctacaaaacaccaagtattgctggatttggttcatcatcaacgtacactagccctgttgtcgaaactattgatctgcctaaacctacatacacacctgcgaaacctgtcttaacagcgaaagctatgaaactaggtggtaaatctagagatgtcgaatcatttgttgatcaactaaaatcagagggagaaaatgtgatttcacaagtggctgcgaataaacctgttgcagctaagttagcctctacaccaaatattcatatggaagaggtccatctaaaacaggaagaaaaactaatggtttctgtaggaaaggatggtggaatacaaagctttgagctccatggtttggtaacattacggataactgatgaaaaatatgctaagataaaagtatatctcgataacaaagataagagaggaattcagttgcagacgcatccgaacgtggataaagaattattcaaaatgaagtcgcagattggtttgaagaatccttcaaaaccatttcctttaggaactgatgtaggtgtacttaaatggcgataccaatctcaagatgaatctgcacttcctctaaccataaactgctggccatctgaaaatggacaaggaggatgtgatgtcaatattgagtatgagctcgaacattctcaccttgaactaaatgatgttaccatcaacattccattacctattgggtgctctcctgttgttgctgagtgtgatggcgagtacaaacacgagtcccgaaggaacttgctgcaatgggtactgccagttattgacaggagtaacaaatcaggagcgatggagttttcgacatcttctgctattccttcagactttttccctttaacagtatctttcacctgtaaacagccttatgcagatctaaaggctgttgaggttcttcatgttgatgatgaaactcctgtaaagttttcaagtgaaacattgttttatacagaaaggtatgaaattgtataa

SEQ ID NO: 176 - DNA, 1269 bp, artificial sequence
  Nezara viridula
atgtcggtaacgtcgtctgacaaaaggaatgaggattgggtaggagagtctaaaaatgggccaagcgacaaagaacattcttatgatggtccacccggtatggaccctgaaggaatcatcgagtccaactgggacgaggtggtggacaattttgatgatatgaaccttaaagaagaacttctgagaggtatttatgcttatggttttgaaaaaccttctgctatacaacaacgggcaattatcccttgtgttaggggtcatgatgttattgcccaagctcagtcaggtactggtaaaacagctacattttccatttcaatattacaacaaattgacactagtgcaagagaatgccaggccttgattttggccccaactcgtgaattggcccaacagatccagaaagtagtcatagccctgggagattttatgggggccatgtgccatgcatgcattggtggtacaaatgttagagaagacatgcgcaaactagaaatgggtgttcatgttttggttggaactcccggacgagttttggatatgattagccgcagagctctaaaaactaacaccattagaatttttgtgttggatgaagctgatgagatgctttctcgtggtttcaaagatcagatccatgatgtatttaaaaatttaaatcatgaagtacaggttatattgctttcagctactatgccatcagatgtattggaggtcagtacatgcttcatgaggaatcctattcgtatcttagttaaaaaagaagaacttaccttggaaggtatcaaacagttttttgtttttgttgagagagaagagtggaagttggatactctctgtgatttgtatgaaacactaagtattactcaagctgtaattttttgtaatacaaggcgcaaggttgattggttgactgagagtatgcataatagagacttcactgtttctgctatgcacggtgatatggaacaaagagaacgagatattattatgagacaattccgtactggttccagtagagttttaatcactacagaccttttggcaagaggcattgatgtgcaacaagtttctcttgtcataaattatgatcttccatctaatagagagaattatattcacaggattggaagaggtggccgatttggtcgtaaaggtgtggcgattaattttgttacagaagaggacaaacgctctcttaatgatattgaacagttctacaacacccgtattgaagaaatgcctatgaatgttgccgacctcatttaa

SEQ ID NO: 177 - DNA, 792 bp, artificial sequence
  Nezara viridula
atggctcgtggtcccaaaaagcatttgaagcgtttaaatgctccaaaatcatggatgttggacaagcttggtggtgtttttgcgccaaggcccagctcaggtccacacaaacttagggaatcattgcccttagtaatttttctccgtaatagactaaagtatgcacttacaaatactgaagtaactaaaatcgtgatgcagcgtctcataaaaattgatggcaaagtgaggacagaccctaactaccctgcaggtttcatggatgtgattagcattgagaaaactggtgaatttttccgattgatctatgatgttaaggggcgttatgctattcacagaattactgctgatgaagccaagtacaagctgtgcaaggttaaaagggtgcagactgggcctaagggtattccttacttagttacccacgacgctagaaccatcaggtacccagatccactcgtgaaagttcatgataccattcagcttgatattgctactggcaaaatcatcgatatcatccgaatggagtcaggtaacctttgcatgattactggaggtcgtaacttgggaagagttggtactgttgtaaacagggagagacatcctggatccttcgatatcgttcatatcaaggatgccagtggccacacctttgccacacggttgaacaatgtgttcatcattggtaagggtagcaaagcttacgtttcattacctaaaggcaagggtgtgaaattgagtatcgctgaggagagggataagaggcttgcggcgaagggtgcatccagctaa

SEQ ID NO: 178 - DNA, 2409 bp, artificial sequence
  Nezara viridula
atggctgatatgaaaagtaatgaagatttgtccactgctatcctgaaaaagaaagatcggccgaatagattgattgttgaagatgcagtcaacgatgataattcagttgttgctctttcacaggctaagatggatgaacttcaattatttcgtggagacactgtgcagcttaaagggaaaagaaggaaagaaaccgtttgtattgtgttatctgatgatacctgccctgatgaaaaaattaggatgaacagagttgttagaaataatctacgagttcgtttgtcagatattgtttcaattcaagcttgtcctgaagtaaagtatggaaaaagaattcatgttttaccaatagatgatactgttgagggattaacagggaacctttttgaagtctttcttaaaccatactttctggaagcatatcgtcctattcataaagatgatacatttgttgtcagaggtggtatgcgtgctgttgaatttaaagtagtagaaacggatcctgctccttattgtattgtagcacctgacaccattattcattgtgagggcactcatatcaagagagaggaagaagaagaagctttaaatgctgttggatatgatgatattggaggttgtagaaaacaacttgctcagattaaagaaatggttgaacttcctttgagacatcctagcttattcaaagccattggtgtcaaacctcctcgtggaatattactttatggaccacctggaactggtaaaacattgatagcacgtgctgtggccaatgaaacaggagcatttttctttttaatcaatggtccagaaattatgagtaaactagcaggtgaatcggaaagtaacctgcgtaaagcatttgaacaagctgaaaaacatgcaccttccataatttttatagatgaattggatgctatagctccaaaacgagacaagacccatggagaagtagagcggagaatcgtctcacaattgcttactttgatggatggtcttaaacaaaattctcatataattgttatggctgctaccaacaggcctaattcaattgatgctgctcttagacgtttcggacgatttgatcgtgagattgatattggtattccagatactactggacgtttagaagttcttcgaattcacacaaaaaatatgaaacttgctgatgatgttaatttagaacagattgcagccgaaacacatggtcatgttggtgctgatttagcatctctctgttcagaagcagctcttcaacagattcgtgaaaaaatggatctaattgatttagaagaagaccaaattgatgccgaagttcttaattctcttgctgttaccatggataacttcaggtatgctatgggcaaaagtagccctagtgcccttcgtgaaacagtggttgaagttcctaatattacttgggatgatattggtggtctcgataatgttaaaaaagagttacaagaattagttcagtatcctgttgaacatccagagaagttcttgaagtttggaatgcaaccttcccgtggtgttttgttttatggaccaccaggttgtggtaagactttgttggccaaagctattgctaatgaatgccaggccaacttcatctcggttaagggtcctgaattattaactatgtggtttggagaatccgaagctaatgtccgtgatatttttgataaggctagagctgctgcaccatgtgttctttttttcgatgaactggattccattgctaaatcaagaggtggaagtgtcggagatgctggaggtgcagctgatagagttatcaaccaaatactcacagaaatggatggtatgggagccaagaaaaatgtctttataatcggagccactaatagaccagacataattgatcctgccatactgagacctggtcgtttagatcagctcatttatatacctttacctgatgagaagtcaagagaagccattttcagagcaaacttaagaaagtcacctgttgctaaggatgttgatttacaatacattgccaaagttacatttggttattctggagccgatcttaccgaggtatgtcaaagagcttgtaaacttgccatcaggcagtcaattgaagcggaaattaaaagagaaaaaagtagattagatggagctacacgaatggatatggatgatgaagatcctgttcctgaaataactcgtgaacattttgaagaggcaatgaggtttgctaggcgatcagtcactgataatgatattcgcaagtatgaaatgtttgctcagacattacaacaatcaagaggttttggaactaattttagattccctgctagctcaaatatccctagcgcaccaggaggtggaggaacagaaactaacaactttccagatgatggagatgatgacctttataattaa

SEQ ID NO: 179 - DNA, 405 bp, artificial sequence
  Nezara viridula
atgactattgaagacgaatcgggcccatctggcgactcagtggacataaataccgctcttaaagaagtactaaaaggagttgtgagaaatggagtcatagtacatggtctgagggagtcagctaaagctcttgacaagcgacaggcattactgtgtgttctggccgaaaactgtgatgagcccatgtacaagaagcttgtgcaagctctctgctcagaacatcaaataccattagttaaggtcgactccaacaaaaaattaggagaatggtccggtttatgtaaaatcgacaagacaggaaacccaaggaaagttgttgggtgctcttgtgtagttattaaggactggggcgatgatacacctcatctagatgtactcaaagattatatgacagaatccatgtga

SEQ ID NO: 180 - DNA, 450 bp, artificial sequence
  Nezara viridula
aaaaaaaaaaaaaaaaaaaaatatgttgtgaacagttattattcgtcaacgacagagaacacttatagcagaaggatgtctggacgtggcaaaggtggcaaagccaagggaaaggcaaagacccgatcatctagggcaggactccagttccccgtcggtcgtatccaccgtctcctcaggaaaggtaactacgccgagagggtgggagcaggagctccggtgtacctcgcagcagtcatggaatacctggctgccgaagttctcgagttggccggcaacgcagctcgtgataacaagaagactaggatcatcccgcgtcatctccagctcgccataaggaacgacgaggagttgaacaagctgttgtcgggagtcaccatcgctcaaggcggagtacttcccaacatccaggccgttctgctgccgaagaagacagagaagagctcataa

SEQ ID NO: 181 - DNA, 4605 bp, artificial sequence
  Nezara viridula
gccgtcttccgttccagtcttgcaaagcggagccagtcctcggcacctcagaatgtaaagtcccatttctgcaacatcaacttgacctttttttttttatcaacactcaagatggatttgagagctgtcatcgttatattggttgctgcatccgcgctaccagcctacgctcaagaaaatgggaccaacctgcttccacgaacaaaaagaaaccctacaaagcttcgtcattcacgacgtttcgccgaaagaatgcccacctcttcttactatgatgattatccgccagctaccaatagccagagtcaggaaaatcataaaccaatcttcaccaactgctcaatgtatcaaccttctgtaccagaagagctgacacataccaccactgttatacaggttaccgcggctgacaaagatccgccagaatcaggagggaaagtaacctatactttcgttgcaactccacaagaaagtcaaaaatttaatattgatcctgaaacgggggttattactaccagacatagctttgatagagatgagccaaatcgagaaaaagaagtttatttaacagttcgagcgactgataatggaaggcctcagcttgatgatgtctgtacattcaaggttattattgaagatattaatgataacgctccagtatttgataaagttgactaccaagaatctgtacctcaagatttaccccctaaacgtgaagtaatgagaatatctgccactgacgttgatgatggaaataacagtattgtaatgtacagcttagaaccaagatctgcagatatgttcaacaagacctattttcaaattgacagtaagacaggtgtgatcacccttgatcgagtgattgatcgtgatcctggttataaatttaaacttagagcaacagccacagatcatggggatatccccaagtcagctgttattaacctggatattcaagtagttgaatctaataagaaagctcctgtcttcacatcaataccagcttcacctattgttcttctagaaaatttcaccgattttactgaaaatattgctactttaactgctatgtctaatgacgaaaaagctcctgtttttgaactagttacgggaagaacagagcaaaccaataaatacagtacttttcggttagaatctgatgcaaatactgctcacataaggcttgctagacgaatggattatgaatcaatcgctgaatatactctcactattcgaatacagaacaaattcaatctggcttcagaaactagtattaatatccagttagaggatgtcaatgataatatccctgcctttactgaagtagtatcaggtgttgtattagaaaatgaacccgctgggactccagtcatgcaagtcagggctattgatgcagacagtaccactgctcataatcaggtcacgtatgaattggctgataataaagaaaattttgctattgatagatacactggtaacattactacaaaaaagatgtttgatagagaggaacaagatttttataatgttaaagttattgctactgataattctccttctgcattatataaaactggagtacctaatgaaggtcaacaggtgtttcgaattgaaatagctgataagaatgatcaccctccaaaatttactgaagcagtatatattgctgaagctatccctgaaaatgctaatacaaatgctcgtgttacccaagttaatgctcaagacaatgatactgcctcgcttgtgcactatagtatattttatggtaatgaaaatgatgcatttgtaattgatgaaactactggtgaaatccgtgtcaataagaatttagattatgaaaccaggaccaattatactttaaaagttaaagcatttgatggagcttatgaagataattgtgaggtgcacataaaaattgaaaatgtaaatgataatcctccagtttttgtttcttatcaaaaaaccattactataatggaagaagaattattcccaggatgcattgctcagcttgaagcttatgatccagatattcctgatagaagtgcacctcagcatatactttattttgttgtaaaacaacagcaaagtatgtggttaaatatcaacaaaaaaggttgcctctcactgataaagcctttagatagagatcctcctaatggtactgagtcttggcaagttttgattggtgccaaagatgaagatggtgggcccacgggggtacaacagaccactgaagtcattattatgttaaccgacataaatgacaatgctccatacttagacatgtcacaaccagtaatttggacagaaaatgaaccccctggagacattgtgaaattaaatgctgaagataatgatggtccagaaaacggtccacctttcactttcaatattgctccatctgctagcactgaaatccagaccaaatttactatatcaggttcaactttaaaatcacttgtcaggtttgatcgtgaagagaggaaatcctattttgtacccattgctattactgatagtggcaaccctagtttgactggtacaagcacattacatgttgtcattggcgatgttaatgacaatccaatgaaaagtggatatagtgaaattttcgtttacaattacaagggagaggccccagatacagaaatcggtagagtatatgtagaagaccctgatgattgggatttacctgacaaacgctttgaatgggctggtatggccagtccatatttttatttagatccaaagactggcatgatcacaatgtcgcaaggaactgttgatcaatcatatgtcctcaactttactgtttttgaaaatacaaccagatatttcagtgctcacagtgtatcagctaccgtcaatgttactgtcaaagaaataccagaagaagctgttgataagtcaggttctgttcgtttagttggaattactgctgaagaatttatagaagctaattctaatggtatcagcaagagaactatgttcaggaaatatttagcaaaattcttgaacattactgaagaaaatgttgatgtgtttactgttttacattctccacacaatacaaatacaagtctactggatgttcgattttcagctcatggttctccttattatagtccagaaaaactgaatgcagcagtgagcgtgcataatgctgaattggagaaagagcttggagttgcgattctcatggtgaacatagatgaatgtctcattgaaaggcagtactgtgagggttcatgtattaattttctgaataaaagtcgtgagccgatcgccgtttacactaatacaacaacttttgttggtgtgagagctgttgtagatcctttttgtaattgtgaggtactttcaaggccagtttgttataatggtggtacacttattaacgacaagtgtgaatgtgaacctggctttgaaggacctcattgtgagatcctaagtgttggatttaatggaaatggatgggccctttatcctccattagaatcttgtgctgattcacatctgtctttggaacttcgttccaataaaaaggatggtcttgtgttttacctagggccaactaaaccgaatcgacttttgaatgtgcaagattttatatctcttgaggtggtagatggctacccagttcttctattggattttggaactggtactgtaaaactagatcccaaacaaatcagacttgatgatggagagcagcatcgtatcgacataatatggtccagaacaactattgaattacaagttgataactgcaagctaccttcatgtttaagcctaaaattaaaagcaggtgacaatgaatttttgaatgtaaatggaccattacaaataggaggctcatttgttgattttaattaccttgacaatcacatgaactggacttataaacctgcaagagtagggtttagtggttgtgttaaaaatgtcacctttaataacaaattgtataatcttggaatgcctggacattcgaaaaatgcagacattggttgtaatgctggtattgcagttgcagtttcttttggaatagatcctagttttataattgccattattatctgcttagctatattactaattctgttgctggcagtggttgtccatcgtagaaaaactgatgacctgtataaagacactgacgatattagagaaaatattattaattacgaagatgaaggtggcggtgaaggtgatatgacagcttatgacttaaatgtcttaaggctcatgtacaatgatgcaatgcaggacaaacctcttccagatcatttgaattctaggccagatgaagttcctgatatatgtggttttctggatggaaaaaaacagtctgttgataatgatcctgaaactaatccttttgatgatgttaggcattatgcttatgaaggtgatggaaatactactggttctctatcatcattagcttcaggaactgatgaaggtgatttgaattttgattatttgtctaactttgggccacgtttccggaagcttgccgatatatatgggaaagattctagtgatgacgatgatgatgatgacaattatcaaactactgcatctgaaagctggtgttaa

SEQ ID NO: 182 - DNA, 1107 bp, artificial sequence
  Nezara viridula
atgtctgacgaggagtattcggagtccgaagaggagactgtaccagagcccgagcctcaaaagaagactgagggcgatggagatccagaatttgtaaaacgccaggaagctaaaacatcagctttggatgaacaactcaaggactacatcgcagaatggagaaaacaaagagcgaaagaggaagaggacctgaagcgcctcaaagaaaagcaagccaagagaaaggtcatgagagctgaagaagaaaagaggctcgctgaaaagaaaaagcaagaggaagaaaggcgagtcagagaagctgaagaaaagaaacagagagatattgaagaaaagaggcgtagacttgaggaagcagaaaaaaaacgacaggctatgatggcagctcttaaggatcaaagtaaaagcaagggtccaaacttcacaatcagcaaaaaggaagctggtctaaacttgtcttcagcacaaatagaaaggaacaaaacaaaggaacaattagaagaagaaaagcgtatttcccttagcataaggattaaaccattaagtattgaaaatcttaacattgacagattacgattaaaagctattgaactctgggattgcattgttaaactggaaactgagaaatatgatcttgaggaaagacaaaaacgtcaagattatgatcttaaagaactgaaggagagacaaaagcagcaactgaggcataaagcactgaagaaaggtttagacccagaggctttgactggcaaatatccacccaaaattcaggttgcatctaaatatgaacgtagagttgacacaaggtcatatgatgacaagaaaaaactttttgaaggcggttgggaaaccttgactgctgaagaattagaaaaaatatggaagtcgagatatgaacaatttactaagcgaaaacatgctaaattgcccaaatggtttggtgagagacctggcaaaaagaaggatgctcctgaaagccctgaagaggaagaagttaaaccaaccgatgatgatgtagaaccagtctatgctgaagaagaagaggcagaggaagaggcagaggaagaagaagaggaagaagaagaggcagaagaagaagaagaagaagaa

SEQ ID NO: 183 - DNA, 852 bp, artificial sequence
  Nezara viridula
atggacgcgatcaagaagaagatgcaagctatgaagcttgagaaggacaacgcgatggatcgcgccctcctgtgcgagcagcaggccagggatgccaacctgagggcagagaaggctgaggaggaggccaggtccttgcagaagaagatccaagccattgagaacgacttggaccaaacacaggagcagttgatgcaggtcttgcagaagcttgaggataaggataaggctctccaaaacgctgagagcgaggtcgccgccctcaacagacgtatccaactgttggaggaggacctcgaaaggtctgaggaaagattggccaccgcaacagctaaactggccgaagcctcccaagcagcagatgagtccgaaaggcagagaaaggttcttgagaaccgcagcttggctgatgaagagcgcatggacgcacttgaaaatcagctgaaagaagccagatttctggctgaagaagctgataagaaatatgatgaggtcgctcgtaaattggccatggttgaggctgatttggaaagagcagaagagagagccgagagcggtgaatcaaaaattgtagaacttgaggaagaactccgcgttgttggtaataacttgaaatcactggaagtgtcagaagaaaaggcaaaccagagagaagaagagtacaagaaccaaattaagacccttacaaacagacttaaggaggctgaagctcgcgctgaattcgccgagcgttccgttcagaaattgcagaaggaagttgacaggctggaggacgaacttgtccacgaaaaggagaagtacaaatacatctgcgacgacctcgaccagaccttctcagaacttgtcggttaa

SEQ ID NO: 184 - DNA, 789 bp, artificial sequence
  Nezara viridula
atggctgtcggtaaaaataagggactctccaaaggaggaaagaagggagttaagaagaaggtagttgaccctttcacaaggaaggattggtatgatgttaaggctccatcaatgtttaatacccgtcaaatcgggaagactcttgtcaacagaacacaaggaactaaaattgcttctgaaggactcaaaggtcgagttttcgaggtgagcttagccgatcttcagaatgatactgatgctgaaaggtcattcagaaaattccgtctcattgctgaagatgttcagggcagaaatgttttgaccaatttccatggtatggacttgaccacagataaactgaggagcatggtgaaaaagtggcaaacattaatcgaagccaatgttgatgttagaaccactgacggatacttgttgagagttttctgtattggattcactaacaaggaccagatgtctcagcgtaaaacttgttatgcccaacacaaccaggtcagagctattaggaaaaagatggttgacaatattacaaacaacattagtaacagcgatttgagggttgtggtcaacaaattgatccccgattccattgcaaaagacattgaaaaaatatgccaaggcatctatcctcttcatgatgtctacattaggaaggttaaggtactgaagaaaccaaggtttgagttgagcaaacttcttgaacttcatggtgatggtaaaggctctgatgaacctggttctaaggtttcaaggcctgaagcttatgaacctccagttcaggaatcagtttaa

SEQ ID NO: 185 - DNA, 663 bp, artificial sequence
  Nezara viridula
atggggagaagacctgctcggtgttatcgttactgtaaaaataaaccttaccctaagtcaaggttttgtcgtggtgtgccagatcccaagatcaggatttttgatcttggaaagaaaaaggctcgtgttgatgattttccattatgtgtacatcttgtttctgatgaatatgaacaactttcatcagaagctcttgaagcaggacgtatctgtgcaaataaatatttagtaaaaaattgtggaaaagatcaattccacatcagaatgagattgcatcccttccatgtcatcaggataaacaaaatgttatcgtgtgctggagctgataggctccagactgggatgagaggtgcttttggaaaaccgcagggtactgtagctagagtacacatcggtcaacctatcatgagtgtccgttccagtgacagatacaaggctgctgtcattgaggcactcaggagagccaagttcaagtttccaggaaggcagaagatctatgtttctaagaaatggggtttcaccaagtatgaccgagagacatttgaggaactgagggctgatggaaaattggcgaatgatggttgcaatgttaagtacaggagagatcatggtcctttgtccaattggaaaaaggttcaagttgaactggcagctgctagttaa

SEQ ID NO: 186 - DNA, 714 bp, artificial sequence
  Nezara viridula
atgacttgcgcgactcccatatcgaagaaaaagaagtttgtggcagatggagtatttagagccgaattgaatgagtttttaaccagagaactagctgaagaaggttattctggtgttgaggtccgtgaaactcctagcaggactgaaattattattatggccaccagaactcaaagtgttctaggagaaaaaggaaggcgtattagagaattaacttcagttgtgcaaaagagatttaactttcagccacaatctttagatttatatgctgaaaaagtcccaactagaggtttatgtgctattgctcaagctgaatctttgaggtacaagttgatagggggtctggctgtccgtagagcttgttatggagttctgagattcatcatggaaaatggagccaaagggtgtgaagtagtagtttcaggaaaacttagaggccaaagagctaagtccatgaaatttgttgatggccttatgatccacagtggtgacccatgtaatgaatatgtaaattcagctacccgccatgtattattgagacaaggagtacttggtatcaaagttaaaattatgttaccatgggatccaacaggaaagaatggacctaagaatcctctgcctgacaacgtttgtgttgtcaatcctaaagatgaaattattccttctgatattaagactatgggaatcgaattacatccaccagctattatttaa

SEQ ID NO: 187 - DNA, 354 bp, artificial sequence
  Nezara viridula
atgtccaaggcagaattagcttgtgtatactctgcactcatcctcgccgatgacgatgttgccgtaactggagagaaaatccaaaccatcctcaaagcagccagcgttgacattgagccctactggcctggcctcttcgccaaagcccttgaaggtatcaacgtcaaggacctcatcaccaacatcagcagtggtgtaggtgttggcggtggtgctccagcagctgctgcaggcggtgctgcacccgctgctgctgctgctccagccggtggtgacaagaagaaagaagagaagaagaaggaagagagcgaacctgaatcagatgatgatatgggcttcggtctgttcgactaa

SEQ ID NO: 188 - DNA, 657 bp, artificial sequence
  Nezara viridula
atgagttttcttagcaaagttttccttggcaaaaaggaagaaaaagcacccacagcttctgaagctatacaaaagcttcgcgaaactgaggatatgttaattaaaaagcaggactttttggaaaagaaaattgagtctgaattaggtcttgtgaagaaaaatggtactagtaatagaagagttgcaattcaagctcttaaaagaaaaaagaggtatgagaaacaattgcaacaaattgatggtaccttggctaccattgaaatgcaaagagaagctttagaaggtgctaatactaatacagctgtccttcagacaatgaagtttgctgctgatgcattaaaaaccgcccataaacacatggatgttgaccaagttcatgatatgatggatgaaattgctgagcaacaagatgtcgcaaaagaaatatcggaagctatttctagccctgtcgcttttggaaatgacattgatgaggaggaacttgaaaaagagctagaggaattagaacaagaagaattagacagagaacttcttggtacaggcccgactgcagatcaattacctgatgtccctgccactcaattacctgcaaaaccaaagccaattgcatcagaagatgatgaagaattaagacaattgcagcagtgggcaacatga

SEQ ID NO: 189 - DNA, 456 bp, artificial sequence
  Nezara viridula
atgggtcgcatgcacgctcctggtaagggtatatcccagtctgctttgccatatcgtcgatcagttccaacttggttgaaactatcaccagaagatgtgaaagaacagattttcaaattaggaaaaaagggactcactccttcacaaataggtgtcattcttcgagattcccatggtgtagcccaagtacgatttgtcactggaaacaagattctccgaatcatgaaggctatgggactagctcctgatcttccagaagacctctattttctgatcaagaaggctgttgctatcagaaagcatcttgaaaggaacaggaaggacaaggactccaagttccgccttatcttggtagaatccaggattcacagacttgctcgttactacaaaaccaagggcgggctcccaccaaactggaagtacgagtccagcactgcatctgctcttgttgcttaa

SEQ ID NO: 190 - DNA, 1284 bp, artificial sequence
  Nezara viridula
atgattcccccgtcttctcggccacaggtcactgtatacagtgacaaaaatgaaccaactggtgaattattgactctccctgcagtctttaatgctccaattagaccagatgtagtaaattttgttcatcaaaatattgctaaaaatcatagacaaccctatgctgtcagtgctgaagcaggtcatcagacttctgctgaatcatggggaactggacgagctgtggctcgtatacctcgtgtaaggggtggtggtacccatcgttctggtcagggtgccttcggtaacatgtgtagaggtggacgcatgtttgcaccaactagggtatggcgcagatggcatcgtaaggtgaatgttaatcaaaagaggtatgcaatggtttctgctatagctgccactggagtgccagcactcgtgatgtctaaaggacacatggtgaatgaagttcctgaaattcctcttgtagtgactgataagattcaggagtatactaaaaccaagcaggcaacaatcttcttacatcgcatcaaggcttggacagatattcagaaggtatacaagtctaaaaggttccgtgctggtaaaggtaagatgcgtaataggaggcgcattcagcgtagaggacctctcattatctacggccaggatcaaggcctaactcgtgcttttcgtaacattcctggtgttgatcttatcaacgtttcacgattaaacttacttaaactggcacctggtggtcacgtgggtaggtttgtaatctggacccaatcagcttttgatcaacttaatgctctctatggcacatggaagaaaaaatcaactttgaaaaaggactacaacttgccaatgcccaagatggtgaatactgatctgtcccgactttttaagtctgaagaaatcaagagtgtcctcaaacctccaaggaagaccatagtcaggagggtaaggaaactgaacccattgaggaatacacgagcaatgctgaagctcaacccatttgctgctgttctgaagaggaaagctattttggctgacaggaaacttaagcttgagagggctattgagagatcaaagaaggaaggagttgagcttacccctcatcaaaagaggtatgttgctatgcttgagagaaggaaagctcagatcaaagccgccaaggctgctaagcctaaaaaggttaagaagcctaaggctgaaaaagccgctgctgatgaagcaaagaaagctgctgtaactaaaaaaccagcaaaaaaggctgctgctcccaaacctcccaaaaaatga

SEQ ID NO: 191 - DNA, 615 bp, artificial sequence
  Nezara viridula
atgacggggttttcggacaagcccatcttaattgatggcaaaggtcacctactgggtagactttcagctattgtagctaaagctgctttgaatggaaacagggtcgttgttgttaggacggaacaaattaatatttcaggaaacttcttcaggagtaaactaaagtacttatcgtttttaagaaaaagatgtaatgttaatccagccagaggtcctttccacttccgggcacccagtaaaattttgtatagaaccatcaggggtatggtgccacacaaaattgaaaggggaaaggctgctttaaggcgtatcaagttgtttgagggaatccctcccccatatgacaaaaggaagcgagtagtagtcccaacagccatgagagttttgtgcttaaaacctggtagggcttattgccatcttggcaggttatcttctgaagttggctggaagtacaaggatgtggtcagggcccttgaaaccaagaggaaggtcagggcagtttttgatattcgcaagaggaattccctcaagaaattgactaaacaagccaaggaaaagatgtccaaagcgaatgctaattataccgctgtaatcaattcttatggatatcgttaa

SEQ ID NO: 192 - DNA, 3543 bp, artificial sequence
  Nezara viridula
atgtcccctccagggcatctacaaggggtggttgggtgtgaggtcgggagccctgctgcatgggataagatgagtgctgccgccagtggatcatccaccaagaaaaggaagaaacccgaaaataaacctcagtctcagattaacaagtgccttaatgaaaagcggaggagggagcaggaaaacatctacatcgaggagcttgccgagcttatctccgcctccttcacagacatgagcagcctctccgtcaagccggacaagtgtgccatcctacaggagaccgttcttcagatcaagacgataaagggtggaggatccgcaagtgatgccgtccaacaaggtgaggtttcatccagcaagcctactattctaactaatgaggtttttgggccactcttacttgaggctttagaaggctttctgtttgttgtgaatccggaaggcaaagttgagttttgtactgagaatatcactcagttcataaaatatcgtcgtgaagaggtgcttggccagccggtgtacaatataatacaccacggcgaccacgctaggttttcgtcttggctcttgcctatgagctggtccaacgactatcatccaccaagacctagaacatttaactgccgtttcctcatcaaacctcctccagatacgactgtggaagaaaagcaacaaagaccgtccaagtatgagaatatgcagatttcctccacacaacttccccaaagtagtggagtagacaaagacgacgatggtagcagcgagtccggaccttgcttgatgtgtgtggctagaagaattccaccaaatgaaaagcctacgggttcacctattgagcaattcacaatgaaactgactacctctggaaggattataaatgtagataataccggcgtttctgctccttattcacaatacatcagtaaggatttaatgaacagaaatttagaagaactagttcaaagcagcgacgttcccaaagttctatctaatattaaagaagcgttgactacaggacaaagttcaacggctatttacaaacttcttattgcccctgcccctgaaaactttcttcacgttcaaactaaatttaagctgtttaaatcagccaatcgccagatggagaatgacttcctaatggctacccattcaatatttggagatattgatatcaatatcaatatgggatcacctgctggcagcagcagtcaggccatcggtggcagtaacaatactaaccaaaaccaacaccaacaccaacaccaacaacagcagcagcagcaacagcagcagcaacaaagcacttcaaccagcggagttgggggccctcttattgctagtgttaacggagcaaataacagagacttgagtaacactattactttaaacaatagctctgccttccattcggtcactctcaactcgaccgatctggatttcaattttgatatttttccgagttcttcgacttgggatcttagcagtgacgagagagtttgggaaaggcccgaatctcgtcagagtttgactccggtagaaagtccattatattccaacccacctgctcaatcccctgccaccactccattttcaactccatacgctttctcaccgattcaggagacaactcaggaagaacccccggaggaagattccggaagactaagaaacctcctgatgaccaagaggccatctacggaatcggatgatggcggtggaggcaacattgctcaacgtaatagacacagaatattaaaaaatcttctgaaccaggaagatgaagaatcgcaaccccaagattcgaaaccgcccaataatatgttattgaagaaccagcagagcggtgatgatggtctccttaaaagccttgggttccgtggagaaaccagcgaggaaagcagaggaggaaggaagcgcccatcttcagatgaaagcgaagaccaacctggcccaaaaagatcttcctcatcccttctggatgccgtacctcccccaacaccctcggcgccgtccgctgcgtcaggtaaatcgaggctttgggagaagaaccaaatgcttgcttctctattggccaagcgcccgactactccggcatcgattccgcctattccagcttctgtcatctccgctacaccgcaggataaactgcaacgtcttgttaaacacccgcaaacaaccggctggtccggcggtagcgtccacaccgctgcggcgtcgcccggccatagcaggcaaggcaggagccctggttataactccgcagcccacatgtgggactctgcgtcatccgatcccgtactctcggacatcctcgatcaagtcatcgagatagtaccagatgttaacacagatgcgccagctctgatgaatatgatcaactcgttggaagctgagactcagcagtctgttcaacaacagttcgtatctcaaacagatttgaatgaaaagatggcgattagcgctatacaaaagtctttaatgctctgcgaatcggcggttaaagggccttcttatcaaggaacgatgtcgcagggttctccaggaccacaaccccagcctcaacagcaaccacaaccacaacagcaacctcagccgcagcagcaacaatttcaccctcctccgatgtatcagcaaaggcagaggtttcctatccagcagcaacaacagattcgaagccagttccccctcagtccaatgattatggctcagaggagtaaaatgcaacagcagcagcagatgcaacaaaagcagcgattactccacatgcagcaacaacaacagcttgttattccgtcgaatgcgactgcctcaaataatgaccccgcactccataatattgatagccttatcaataataccgttgctccgaacgtgtcgctccagagatcgagcagcgttcctgattcccagctttccccagtgggcaattacccaggcatgggatccgttccctcaccaggccaaagaaggcctttctcacctgtgaacggtggaatgaccaatttctccaatagcggcggaggggggccatcttctggcagcggccctcaggcgaggctctctcctagttctataacgggctaccaacagcaacctcagctgtctccaaggctctctcagggccaacaaggttatggcggtggtggtgctagctggcctcagcagaattcacggctatccttgcagcagcaggagaacccggtcctcaatgctcaattgacaagcggaggacgagggtacgcaagggctaccacagcaggtttacctcccgtaagatcgctcgctggccctcagcggttccccacaggtgctgaccagcaggccagttcttcctcgtaccaatttcggctgcagcgccaggtgtcagcacctcagcctcagcagtcgtcgccgaatgcccagttaccaggaggtaataacggtgtcaccgagtacgtaagacaagagctgcgtgcgatggtcggcgccagaaccagtggaagtgggcgtcctcaggttcccggctctcttcccctacctacgcctgcggttgacctcgattct

SEQ ID NO: 193 - DNA, 411 bp, artificial sequence
  Nezara viridula
atggggaagattatgaaatctggtaaagttgtgttggtgctgagtggtagatatgctggaagaaaagcaattgtgcttaaaacttgtgatgaaggaactcaagagaaggcatatgggcatgcaataattgcaggcattgatcgctatccccgcaaagttcataagagaatgagcaaaacaaaaatccacaagaggtctaagatcaagcctttcttgaaggttatgaactacaaccaccttatgcccactcgttacacagtatctgagatcgcccctgaccagaaggttgttacgaaagatttgaaggacccaatgaagaagaagaaaatacgtttccaagttagggtgaaattcgaagaaaggtacaagcaaggtaaaagcaagtggtttttcgaaaaattaaggttttaa

SEQ ID NO: 194 - DNA, 510 bp, artificial sequence
  Nezara viridula
acaaaaaatagtatgcgagagttacacattcgcaaactctgccttaacatttgtgtaggagaatctggtgacaggcttactagagctgctaaggtattggaacaacttacaggacaacaacctgtattatcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaagtataggtatttacggtcttgacttttacgtagtattaggaagacccggattcaacgtagcccacaggaggtcaaagactggtaaagttggattctcacacagattgacaaaagaggatgccatgaagtggttccaacagaaatatgatggtatcatccttaacagc

SEQ ID NO: 195 - DNA, 5874 bp, artificial sequence
  Nezara viridula
atggcgtcgaaaggacctgcaggtatgcaagtaggggctgatgaccccgatccaaccccatatctcttcgtatctctggaacagaagagaatcgatcaaacgaaaccatacgacgccaagaaggcttgctgggtccccgatgaagccgaaggtttcctccagggtgaaatccaaggaaccaagggagatattgtctcagtcaagctccccggtggcgaaacaaaagacttcaagaaagatctggtcggccaagtgaacccacccaagttcgagaaatgtgaggacatgtccaacttgacctacctcaacgacgcttctgtcctgtataaccttaagcagagatactatcataagctaatttacacatactccggtctgttttgcgttgctatcaacccttacaagagattccccgtatacaccatgaggtgcgccaagttgtacagaggtaagaggaggaatgaagtcccacctcacatctttgccatctctgacggtgcttacgtaaacatgttgaccaacaaagaaaaccagtctatgttgattactggagagtctggtgccggaaagactgaaaacacgaagaaggtaattgcctacttcgccaccgttggtgccagcacaaagaaagaagaagtatcagaaaagaagggtaccctagaagatcaagtcgtccaaactaaccctgtactagaagcctttggtaatgccaagacagtccgtaacgataactcctctcgtttcggtaagttcatccgtatccacttcggaccatcaggaaaactggccggagctgatattgagacctatctactggagaaggctcgtgtcatctcccaacagactctggaaagatcctaccacattttctaccagatcatgtctggtgccgtaaagggagtcaaggagttatgtctgctgtccaacgacatttacgaatacaactacgtcagccagggaaaaatttctattgcgggagtcgatgacggagaggaaatgcagttgacagatgaagccttcaacgtcttgggtttcacccagcaagagaaggatgacatctacaagatcactgctgctgttatgcacatgggttgcatgaagttcaagcagaggggtcgtgaagaacaggctgaagctgatggtgtggaagaaggtatcagggtcggtaagctcctcggagtcgatggtgaagaactttacaagaacttgctgaagcccaggatcaaggtcggtaacgaattcgtcacccagggtaggaatgtatctcaggtcacatactcagttggtgctatgtccaagggtatgtttgatcgtctcttcaaattcttggtcaaaaaatgtaacgagaccctggacacaaaacagaagaggcagcacttcattggtgtactggatattgccggttttgaaattttcgacttcaacggtttcgagcaactttgcatcaactttaccaacgagaaactgcaacagtttttcaaccaccacatgtttgtgttggaacaagaggaatacaccagggaaggaattgagtgggctttcatcgatttcggcatggacttggccgcctgcattgagctcattgaaaagcccatgggtatcctctcaattcttgaggaagagtctatgttccccaaggctaccgataagacctttgaggacaaactgaacaccaaccatctaggcaaatctcccaacttccagaagcccaaaccaccaaaaccaggttgccagcccgctcacttcgccatcggtcactacgctggtgttgtatcgtacaacatcacaggatggttggaaaagaacaaggaccctctgaacgacactgtcgttgaccagtacaagaagggttccaacaagctgttgtgcgaaatcttcgctgatcacccaggacagtccggtggtgctactcaggatgctggtggcaagggtggccgtggaaagaagggtggtggcttcgccaccgtatcttcctcctacaaggaacaattgaacaacttgatgaccaccttgaggagcacacaaccccactttgtccgttgtatcattcccaatgaattgaaacagccaggtgtcatcgactctcacctggtcatgcaccaactgacctgtaacggtgtacttgaaggtatccgtatctgtcgtaaaggtttccccaacaggatggcataccccgacttcaagctccgatacaagatccttaacccagctgccgttgataaattaaccgacgagaaggcgatggctggagtcatcttggaatccacagggctcgatcccgacatgtacaggcttggccacaccaaggtcttcttcagggctggtgtcctgggtcagatggaagaacttcgtgatgaaaggctcagcaggatcatctcctggatgcagtcatacatccgtggttacctctgcagaaaggaattcaagaaactccaagaacagagactcgccctccagatcgtccagaggaacttgagaaggtacctgaatttgagaacatggaactggtggaagatgtggtccaaagtaaagcccctgctcaacgtagccaacgtagaggaagagatgaggaaactggaggagttggtcgctcaaacccaagccgccctcgagaaggaagagaaagcaaggaaggaggttgaggccctcaatgccaagctgctccaggagaagaccgagctcttgaggaacctcgagggagagaagggcacacttggaagccttcaagaaaggtctgccaagctccaggcccagaaggctgacttggagtcccagcttatggacacacaagaaagacttcaacaagaagaggacgcaagaaaccaactgttccagcaaaagaagaaacttgaacaagaaaacggcagtctcaagaaggacattgaggacctagagctttccgtcaccaagagcgaccaagacaaggctagcaaggaacaccaaatcagaaacctcaatgatgagattgcccaccaagacgaactcatcaacaaactcaacaaagaaaagaagatccagagtgaacacaaccagaagactgccgaggaactccaagccgccgaagacaaaatcaaccacctcaccaaagtcaaatcgaaacttgaacagactttggatgaactcgaagactcactcgaaagagaaaagaaacttcgtggagatgttgagaaggccaagaggaagactgaaggagacctcaaacttacccaggaagctgttgccgatcttgaaaggaacaagaaggaacttgaacagaccatccagaggaaggacaaggaaatggcttccctcactgccaagcttgaagatgaacaaggtatcgtcaacaagactggcaaacagatcaaggaactccagtcccgaattgaagaacttgaggaagaagttgaagccgagagacaagcccgcggaaaggccgagaaacaacgtgccgacctcgcccgcgaacttgaagagctcggtgagaggttggaagaagctggtggtgctacttccgcccaaatcgagctcaacaagaagcgagaagctgagatgagcaaactgaggagggacttggaggaagccaacatccaacacgaaagcaccctcgccaatctccgcaagaagcacaacgatgccgtcagtgaaatgggtgaccaaattgaccagctcaacaaactcaagaccaaggttgagaaggaaaaatgccaatacctgtgtgaattgaacgatcttcgtgcctccatcgaccatttgaccaacgagaaggctgccactgaaaagattgccaagcaactccaacaccaactcaacgaagtccaaggaaaactggatgaagccaacaggtctctcaacgactttgattctgccaagaagaagttgtcaattgagaactcagatctcctcagacaacttgaggaggctgagagccaagtatctcagttgagcaagattaagatctccctcaccacccaattggaagacactaagaggcttgctgacgaagaggctagggaaagagctacccttctgggcaagttccgcaacttggaacacgacctggacaacctcagagaacaggtagaggaagaatctgaagctaaggcagatatccagagacaattaagcaaggctaatgctgaggctcaactctggaggcataagtacgagagcgaaggtgttgccagggctgaagaactcgaagaagccaagaggaaactacaggccaggctcgctgaggctgaggaaactattgaatctcttaaccagaaagtcattgctcttgagaagaccaagcagaggctcgccaccgaagtcgaagatcttcaactggaggttgaccgtgccaatgccattgccaatgctgccgaaaagaaggccaaggctatcgacaaaatcattggtgaatggaaactcaaggttgatgaccttgcagctgaacttgatgctagccaaaaggaatgcaggaactactcgactgagctcttcaggttgaaaggagcatatgaggaaggacaagaacaacttgaagctgtccgcagggagaacaaaaaccttgctgatgaagtcaaggatctccttgatcaaattggtgagggtggacgcaacatccacgaaattgagaaacagaggaagaggcttgaagttgaaaaggatgaactccaagctgctctcgaagaagctgaagccgcccttgaacaggaagaaaacaaagtcctcagggctcaacttgaactcagccaagttaggcaagaaattgatcgtcgcatccaggagaaggaagaagaatttgaaaacaccaggaaaaatcaccaacgtgccctcgactctatgcaagccagtttggaagcagaagccaagggtaaggctgaggcactccgcatgaagaagaaactggaagctgacatcaacgaacttgaaatcgctctcgatcatgccaacaaggctaatgctgaagctcagaaatccatcaagaaataccagcaacaacttaaggatgtccagaccgcactcgaggaagaacaaagagctagggatgatgcccgagaacaactgggcattgccgaaaggcgagccaatgctcttggaaacgaactcgaagaatcaagaactctactggaacaggcagaccgcggccgtcgccaggcagaacaagaacttaccgatgctcacgaacaaatcaacgaactcgcagctcaagccacaagcgcttctgctgccaagcgcaagctcgaaggagagttgcagacactccatgccgacctcgacgaacttctcaacgaagccaagaactcagaagagaaggctaagaaggctatggttgatgctgcgaggttagcagatgaactcagagctgaacaagaccacgcccagacccaagagaaactccgaaaggccctcgagacacagatcaaggaactccaagtcagactggacgaagccgaaaacaacgccctcaagggaggcaagaaggccattgccaagttggaacagagagtcagggaactcgaaaacgagcttgatggagaacagaggagacacgctgacgcccagaagaacctccgcaaatctgagcgcaggattaaggagctcagcttccaatctgatgaagataggaagaaccacgaacgcatgcaagaccttgtagacaaactccaacagaagatcaagacttacaagaggcagattgaagaagccgaagaaatcgctgccttgaacctcgccaaattccgcaaagcccaacaggaacttgaagaagctgaggagagagcagaccttgccgaacaggctgttacaaagctgagaacgaaaactggcggcagagctggatcaactgcaagagccatgagcccagtgggccagaaacaaaggagagtaccaattgatttggagtaa

SEQ ID NO: 196 - DNA, 768 bp, artificial sequence
  Nezara viridula
atgagttcgataggaactgggtatgatctgtcagcgtcacagttttctcctgatggtagagtttttcaagttgaatatgcacaaaaagctattgaaaatagtgggactgtcataggtctgcgaggcaaagatggtgttgttttagctgttgaaaagttggtcacatcaaaattatatgaaccgggtgccaataaaagactttttactattgacaaacacattggaatggctgtagcaggtctgatttctgatgctagggcagttgcagaagttgcaaggacggaagctgctaattacagatctcaatacaagagcagtatacctcttaaatacttgaatgagcgagtgtctatgtatatgcatgcttatacactctacagtgctgtaaggccatttgggtgcagcgttatactcagcacttacacagaagaagacggtccagaaatgtatatgatagatccatcaggagtttcatatggttattttggttgtgctgttgggaaggcgaagcaagctgcaaaaactgaaattgaaaaattaaaactgaaagatatgtcatgtcaggagctggtgaaggaagcagcccgaattatttaccttgtccatgacgaattaaaggacaaacagttcgagctggagatgagctggattggctctcagacaagtggtgtaaatcaacaagtccctgctaatgttcatgctgaagcagaaaaagatgctaaagctgcgatggaagaagactccgattcagaaacggaagatatataa

SEQ ID NO: 197 - DNA, 804 bp, artificial sequence
  Nezara viridula
atggttgaaacatcagtagttagtcctgcagcacctgctgcaggcaataagaaggcgagctcaaccagaaagcctcagcgtaggaattacaatcttggttccggagtttacaggtttagcagaactcgcatgtttcataagaaggccttgtggaaatttattggtaagaaaacccctaagaccccacgtcccaaaaggaaaactactcttgaaaaaaaaattggtggtgagaagaatggaggtactcgtactgtctatttaaagaagaggacaaaatcttatcctaccactaacaaggtgagaaaacacccaagcaaaacatatttttctcagcacaagagacgattccgtgcatcactaaaacccggtgctattgtgattctgcttgctggactgcacaaaggaaaaagggcagtacttttaaaaaatatggctagtggacttctccttgtttctggtccattctctttgaatggagtacctcttagaagaatacatcccaactatgttatagccagttcaactcaaattgatctgtctggtgttaaattgcctgagcatatgaatgataggtacttcaagagagttaaagcaaaaaaggccaagaaaactgatggtgaaatctttgctgctaaaaaagaaatctacaaaccatccgaacagaggaagaccgaccagaaagaggtagacaaacagattttgcaggctattaagaaacatgaacatagtctacttctaaggaagtacctgtgcacaatgtttggccttcgaagcagtcagtatcctcacaggatgaaattttaa

SEQ ID NO: 198 - DNA, 732 bp, artificial sequence
  Nezara viridula
atgtctaccaaagacaaattgcccattttcccttctcgaggtgctcagactttgatgaaaggaagacttgtgggtgcacaaaaaggtcacagtttgttaaagaaaaaagcagatgccctgcaaattaggtttaggatgatcctcagcaaaattattgagacaaaaactctgatgggagaagtgatgaaagaagcagctttttcattggctgaagcaaagttcgctactggagattttaaccaacaagttttacaaaatgtacagaaagctcaaataaaaattagaacaaagaaggataatgttgcaggtgtgacactgcccgttttcgagagctatcaagatggaacagattcctatgagctggctggattggctagaggaggacaacagttagcgaaactaaagaagaattatcaaaaggcgataaaacttctcgtagagctcgcttcattacaaacatcttttgttacgctagatgaagttatcaagcttacgaacagaagagttaacgctattgaacacgttattatacccagaattgaacgcacacttcagtatatcatttccgaattggatgagttggaaagagaagaattctatagattaaaaaagattcaagataagaaacgtatcgctcgtcaaaaagctgaagcaaagaaagcagtggacgctgccgcagcaacgatggcgagcaacattctcgaagaaaacgatgaggacctcctattttaa

SEQ ID NO: 199 - DNA, 666 bp, artificial sequence
  Nezara viridula
atggccccaagaggaaataatatgatccctaatggccatttccataaggattggcaaagatttatcaagacctggtttaatcaacctgctcgcaagtatcgccgaagaataaagagggtcaagaaagctagggccttggctccaagaccagcaactttactgcgtcctgctgttaggtgccctactgtgcgataccacacaaaattgagggctggcagaggcttcacattagaagaaattaagagggttggattgtgccctggatttgcgagatctatcgggattgctgtcgatcacaggagaaggaacaagtcagtcgagtctttacaattaaatgtacaacgtctgaaggagtatcaagctaagctaatcttgttcccaaccaagaagagcaagaaggtgaagaagggagaggcttcggccgaagaacaagctttagctacccaggtatcttcacctgtgatgccgatcaagcaaactgttgtaaaatataaagccagaactattactcctgaggataagagcttctctgcttatggagctttaagaaaggcaagggctgatgtgagacttgttggaatcagagctaaaaggctaaaggaagcagctgataaccctgaaactgttgagaaggctgctaaacagaagaaagttaaagcaaaataa

SEQ ID NO: 200 - DNA, 537 bp, artificial sequence
  Nezara viridula
atggatggattattattggaacctactctttatactgttaagggaatggtgattttggacaatgatggacacaggatattagcaaaatactatgatccaagtgtctttccaacttctaaggaacaaaagggatttgaaaagaatttgtttaacaagactcatcgagctaatgcagaaataattatgttggatggacttacatgtgtttataaatctaatgttgatttatttttctatgttatgggaagttcacatgaaaatgagttgatattgatgagtgtacttcaatgcctttatgattcaataagtcaaatattgagaaaaaatgttgaaaaacggactctcttagaaaatttagaaattgtaatgttagccatggatgaaatttgtgatggaggaataatattagaagctgatccaacgagtgttgttcaaggagtagctttgaggacagatgatatcccacttggtgaacaaactgttgctcaggttcttcagagtgcaaaggagcaaattaaatctgcaatattaaaataa

SEQ ID NO: 201 - DNA, 549 bp, artificial sequence
  Nezara viridula
atggggaatatgtttgcaaatttgttcaaaggcctgtttggcaaaaaggaaatgagaatactgatggttggtcttgatgctgctggaaaaaccactattttatataaacttaaattaggagaaattgtaaccacaatcccaactattggatttaatgttgaaactgttgaatataagaacataagtttcacagtctgggatgttggtggtcaagacaaaattcgacccttgtggcggcattattttcaaaatactcaggggctcatttttgttgtagacagtaatgatagggaacgtattggtgaagcgcgagaagaactgatgagaatgctggcagaagatgaattaagggatgcagttcttcttatttttgcaaataagcaggatctgccaaatgccatgaatgcagctgagataacagacaaactcggcctacactcattgcgcaatcgcaactggtacattcaagcgacgtgtgcgacctcaggcgatggtctatatgaaggcctcgattggttgtcgaaccaactgaagaatgccaaccgctag

SEQ ID NO: 202 - DNA, 384 bp, artificial sequence
  Nezara viridula
atgactgatgaagttaatcctaaagcctacccattggctgatgctaccctcactgctaagatattaaatgttgtgcagcaagctctgaactacaagcagttaaggaaaggtgccaatgaatctactaaaactttgaatcgaggattagcagagtttatagtgatggctgctgatgcagaaccactagaaatattattgcatttacctctattatgtgaagacaaaaatgtgccatatgtttttgtccgttccaagcaagctcttggaagagcgtgcggagtttctcgacctgttgtcgcttgttcagtgactgtcaatgaaggatctcagctcaagccacagataacaaaaatacaacaagacatagagagacttttagtgtaa

SEQ ID NO: 203 - DNA, 1302 bp, artificial sequence
  Nezara viridula
atgcccgattatcttggtgatgatatgagaaaaacaaaagaggagaaggaagaagaaaaggatattaaatctcttgatgaagctgatatcgctttacttaaaacttatggacagggtcaatacacaaaaagcattaaaagtgttgaagatgatatacagacgataatcaaacgtgttaatgaactaacaggtattaaggaatcagatactggtttagctcctcctgctctatgggacttggccgcagataagcaaatactccaaaatgaacagcctcttcaggttgccagatgtacaaaaattattaatgctgattctgaagacccaaaatacattataaatgtaaagcagtttgcgaaatttgtggttgacttagctgattcagttgcacctactgatattgaagaagggatgagagtcggtgttgatagaaacaaatatcaaattcagatacctcttccaccaaaaatagatccaactgtaactatgatgcaggttgaggaaaaacccgatgtcacttacagcgatgttggtggttgcaatgaacaaattgaaaaattgagagaagtagttgagacacctttgttacagcctgaaaagtttgtgaatttaggaattgaaccaccaaaaggagttcttctttttggtcctcctggtacaggaaaaacactttgcgctagagcagttgctaatagaaccgatgcttgttttataagagtaattggttcagaacttgtccaaaaatatgttggagagggagcaagaatggtgcgtgagctctttgaaatggctagaagtaaaaaagcttgcctaattttttttgatgaaatagatgctattggtggagccaggtttgatgacggagctgggggtgataatgaagttcaaagaacaatgttagaacttatcaaccagcttgatggttttgatcccaggggtaacattaaggttttaatggcaacaaatagacctgacactttggaccctgccttgatgagacctggaaggctggacagaaaagtagagtttggactacctgatctggaaggtcgttctcatattttcaaaattcatgcacgctcaatgagtgtagagagagatattcgatttgagttacttgctagactctgtcccaatagtacaggagccgaaatcagatcggtttgcacagaagctgggatgtttgcaattcgtgctcgaaggaaagttgctacagaaaaggatttccttgaagcagtaaataaagtgattaaatcttatgctaaattctccgccactccaagatacatgacatataattaa

SEQ ID NO: 204 - DNA, 444 bp, artificial sequence
  Nezara viridula
atgaagatgaacaagttagtgacctcttctaggaggaaaaatcgcaaacgtcatttcacagcaccatctcatattagaaggaaattgatgtcttctcctctctccaaagaacttaggcagaaatacaatgtccgcaccatgcctgttaggaaagatgatgaagttcaagttgttagaggacattataaaggacagcaggtaggcaaagttattcaggtatacagaaagaagtttgttatttatatcgagagaattcaaagagagaaagccaatggtgccagtgtgtatgttggcatccacccttccaaaacggtcattgttaaactaaaaattgacaaagacaggaaagaaattttggatagaagatccagaggaagagctctagcccttggaaaagacaaaggaaagtacaccgatgagaacacagcaatggatacatcttaa

SEQ ID NO: 205 - DNA, 1698 bp, artificial sequence
  Nezara viridula
atggctgtggtggaacaaccttgttatactctgatcaattttccatctgatttagagcctcctaatgaaatgcagctaaaatctgatttagaaaatggagacactaaagcgaaaattgaagctttgaaaaatattattcatttaattgcaaatggagagcgtctacctggtttacttatgcatatcatacgttttgttttgccatcacaagaccataccataaaaaaattactgcttatattttgggaaatcgttcctaaaactactccagatggcaaacttctccaggaaatgattttggtttgtgatgcctatcggaaggacttacaacatcctaatgaatttgtcaggggatctacattacgttttctatgtaaacttaaagaacctgaattgcttgagcctttaatgcctgctataagagcttgtttagagcatcgggtttcatatgtacgaagaaatgcagtacttgcaatatttaccatttataggaattttgaattcttagctcctgatgcaccagaacttattgctaatttcttagatggggagcaagacatgtcatgtaaaagaaatgctttcttaatgctcctacatgctgaccaagaacgtgccttatcctacttagcttcatgtcttgatcaagtgacttcctttggcgatatacttcaattagttattgttgaattaatttataaggtttgccatgctaacccttctgaacgttctcgatttatacgttgcatttataatttactcaattctaacagtcctgctgtgcgatatgaagctgctggaactttaatcacactttcgaatgctcctactgcaataaaagctgctgcttcttgttacattgatttgataataaaggaaagtgataataatgttaaattaattgtattagatcgtcttatatctttaaaagaaattcctactcatgaacgggttcttcaagatttagttatggatatattacgtgtgctagccagtcctgacatggaagtaaagaaaaaagccttaagcctagcactggatctcactacttcacggtgtgttgaagaaatggttttaatgttaaaaaaagaagttgctaagacacataacttgacagaacatgaagatgctggaaaatatcgtcaacttcttgttagaactcttcattcctgttgcatgaagtttccagatgttgctgcttcagttataccagtattaatggaatttctctcagatacaagtgaactagcttcgtatgatgttcttatatttgtccgagaagcaattcataagtttgattctttaagggttttgatcatagagaaattattagaagcgtttccaaccataaaatctatgaaagttcatcgagctgctctttggatattgggtgaatatactacttcagttacagatattaaagaagtcatgaaacaaataaaacatgcccttggagagataccacttgtcgatgatgaaataaaaagagcttctggagagaaagttgaggaagttgatcatcgagatcaagtaaaactggttacatctgatggaacatatgctacacaatcaatatttaacaccattctggcaattaaaaaagaggatcgacctcctctcagacaatacttgattgatggagactttttttattggtgtatctgtggcttctacgcttgtgaaattagcattacgttataa

SEQ ID NO: 206 - DNA, 492 bp, artificial sequence
  Nezara viridula
atgcctttccagaggtttgttgaaactggaagaatcgcatacattgccgatggaccttacaaaggcaagttgtgtgctattgtggatgtcattaaccagaccagggctttagttgatggtcctgaaactggagtaccaagatgtggtataagattaaatcaattacatcttacaaaatttagaattcgtttcccatatactggttcaacacgtgttgtacgaaaagcttggaaagatagcaacttagatgctaagtggaaggaaagtgtttgggccaaaaagttagaagcaaaaaaaataagagccaatatgaatgactttgacaggtttcgccttaataatgctaggagaaccaggagcaaaatcaccaccaatgcatttttgattctgaagaaacaagctaaaaaggctaaaaaaaccgaagtaaaatctaaagacaagaaaccagaagctaaaaaggtttctgctaagaaagcagaaaaaaagaaataa

SEQ ID NO: 207 - DNA, 5043 bp, artificial sequence
  Nezara viridula
atgtctcaaatattaccgatacgcttccaagaacatttacagctttcgagcgtaggaataaacccaactagtgtaggctttaacacattaacaatggagtctgataagttcatttgtgttcgagaaaaagttggagaaacttctcaagttgtgataatagatttaaatgatactgctaatccaataagaagacctatttcagctgattcagccatcatgaatccagctagtaaagtaatagcactgaagggaaaagctggtcctgatggatcaactactcagaaaacactgcagatttttaatattgaaatgagaagtaagatgaaagcacacacaatgacagatgaagtagttttttggaaatggatatcccttaatacgcttgctttagttactgaaacatctgtttatcattggagcatggaaggtgattcacaaccagtaaaaatgttcgatagacattctagtctgaatggttgtcaaattattaattacagaacagatcctaaacaaacctggcttttattaattggaatctctgctcagctaaatcgtgtagttggggctatgcaattatattcagtagagcgcaaatgctcacagcccattgaaggccatgctgcatcatttgcccagtttaaaatggaaggaaaccctgatgtatctactttattttgcttcgctgttcgaacacttcaaggaggaaagcttcacataattgaggttggacagcctcctacaggaaaccagtccttctccaaaaaagcagttgatgtattttttccagtagaagcccaaaatgattttccagttgctatgcaggttagctctaagtatgatgtaatctatcttataacaaagtatggatacattcatttgtatgatttggaaacagctacctgtatttacatgaaccgtattagtattgatactatatttgtcactgctcctcatgaatcaactggtggtatcattggtgtgaatagaaaaggccaggtgctatcagtgagcgttgaagaggaccacataatcccatatatcaacaatatattacaaaatcctgatctagcattacgcatggctgttagaaataacctagctggagctgaagatttgtttgttaaaaaattcaatatgcttttccaaaatggacagtatgctgaggctgctaaagtggctgcaaatgcacccaagggaattctccgaactcctcaaacaattcagcagttccagcaaataccaaatccacaaggtcaaacatcccccctccttcagtatttcggaattttgcttgatcagggtcaattgaataagtatgaatccttggaattatgcagacctgttttggctcaaggaagaaagcaattattggaaaaatggctgaaagaagacaaacttgaatgctctgaagagcttggagatttggtgaaacaaacagatccaactcttgctctctcagtttatttaagagctaatgttcccaacaaggttatacaatgctttgctgaaactggacaatttcaaaaaattgtattatatgcgaaaaaagtaggttattcgccagactacattttcctgctccgaaatgtaatgcgtgttaatcctgatcaaggtgttagctttgctcaaatgcttgttcaagatgaagaaccactggctgatataaatcagattgttgatatactaatggagcaaaacatggtacagcagtgcacagcattccttttggatgcccttaaaaataatcggccttctgaaggcccattacaaactaggcttcttgaaatgaatttaatttctgctcctcaggttgctgatgctatacttgggaaccaaatgtttacacactatgatagagcccatattgctcagctttgtgagaaggctggtctactccaaagagcattagaacattatacagatctttatgatataaaacgagctgttgttcacactcatcttcttggccctgattggctcgtgggttattttggtaccctttccgttgaagattctcttgagtgtctgaaagccatgttaacagcaaatattcgacagaatttaaatatatgtgttcagattgcaactaagtaccatgaacagctgacaaccaaggctttgatagatctttttgaatcattcaaaagttatgagggattgttttatttcctgggctcaatagttaatttcagtcaagatcaagaagttcattttaaatacattcaggcagcatgtaaaacaggacaaataaaagaagttgaacgaatttgccgtgaatctaattgctataatccagagagagtaaaaaattttttgaaggaagcaaaattgacagatcaattaccacttattattgtttgtgatcgatttgatttttgtcatgatttggttttatatttatacagaaataatttgcaaaagtatattgaaatttatgtacaaaaggtcaatccttctcgtttacctgttgtaataggaggattattagatgttgattgctctgaagacattattaaaaatttgatgatggttgttagaggtcagttttcaactgaggagcttgttgcagaagtagaaaagcggaatagattgaaacttttgcttccttggttggaaactcgtgttcatgaaggctgtgttgagcctgctactcataatgctctagcaaagatatatattgatagtaacaataatccagaacgattcttaagggaaaatcagtattatgatagctgtgttgtaggaaagtactgtgaaaaacgagatccacatttggcttgtgtagcctacgaaagaggtcaatgtgatagagagctcataaatgtttgtaatgaaaattccctctttaaatcagaagccaggtacttggttagacgtaaagatcctgaattatgggctgaagttcttaatgaaaacaatccttacaagagaccattaatcgatcaggttgttcagactgctctttcagaaactcaagatcctgaagatattagtgttactgtcaaggcttttatgactgcagatttacctaatgaacttattgaacttctagaaaaaatagttcttgataattcaatatttagtgaccacaggaatctacaaaatctcctcattcttactgctataaaagcagaccgatcaagagtcatggaatatattaatcgtttagataattatgatgctcctgatatagcaaatattgctatcaattatcaattatatgaagaagcatttgcaatattcaaaaagtttgatgttaacacttctgctatccaggttttaattgaaaatgtgaacaatcttgatagagcctatgaatttgctgaacgttgtaacgaaccagctgtgtggagtcaattagccaaagctcaactgcaacatggccttgtgaaagaagcaattgattcattcataaaagctgatgacccttctgcttatgttgatgttgttgagacagctcacaaaacagaaagctgggaggatttagttcgttatttacaaatggcaagaaaaaaggctagagaatcttatattgaaagtgagctaatttatgcttatgctcgcaccaaccgattggctgatcttgaagaatttatctcaggtccaaatcatgctgatattcaaaagattggtgataggtgttttgatgataagatgtatgaacctgctaaactgctttataacaatgtttcaaattttgctagactagctattacattggtccatctaaaagaatttcaaggagctgtggacagtgcaagaaaagcaaacagtacaagaacttggaaagaagtctgttttgcttgtgtggatagtgaagaattcagattagcccaaatgtgtggtttgcacattgtggtccatgcagatgaactagaagatctgatcaattattaccaggaccgaggatattttgaagagcttataaatctgttagaagcagcacttgggttagaacgtgctcatatgggcatgttcacagaattagctattctgtattctaaatacaaaccagccaaaatgagggaacatttagaattattttggtctcgagttaacattccaaaggtcttgagagctgctgagcaagctcatttatgggcagagttagttttcttatacgataaatatgaagagtatgacaatgctgtatctgcaatgatgaaccatcctactgaggcttggagagaaggccattttaaagacataattactaaggttgcgaacattgaactatattacaaagctattcaattttatttggattacaaacctctccttttaaatgatatgttgttggtattagctccaagaatggaccatactagagcagtgaatttctttgcaaaggtaaaccatttacagttggtcaagccttatcttcgctcagtacaatcattaaacaataaagcaataaatgaagctctgaataatcttttaattgaagaagaagactttcagggtgttagaacatcaattgatgcttttgataattttgataatattgtattagctcaaaagctagaaaagcatgagttgattgaatttagaaggatagcagcatatctgtataaaggaaataaccgatggaagcagagtgttcaattatgcaagaaggatagactgttcaaggatgcaatggaatatgctgcggaatcaaagaattcagaagttgctgaagaacttttagcatggtttttagaaaaaggaaatcatgactgttttgctgcttgtttgttccaatgttatgatcttcttcatcctgatgttattctggaacttgcatggcgacataatatcatggattttgctatgccatatattattcaagtgacaagagagtatattaccaaggttgataaattagaagaatccgaagcaagaaggttagaagaaagagcagagcaagatcataaacctatgatgatgccggagccccaactaatgttaactgctggcccaggaatgataggacctggtttttctcctgcttatcctaacacttttaccactggcatgccttatcaaggttatggcatgtag

SEQ ID NO: 208 - DNA, 471 bp, artificial sequence
  Nezara viridula
atgcagatcttcgtgaaaaccctcacgggtaagacaattacccttgaggttgagccttctgatactatcgaaaatgtcaaagctaaaattcaagataaggaaggcattcctcctgaccagcagcgtttgatttttgctggcaaacagttagaagatggccgtactctttctgattacaacatacaaaaggaatctaccttgcacttagtgcttaggcttaggggaggtgccaagaagcgtaagaagaagaattactccactccaaaaaaaatcaagcacaagaagaagaaggttaaactagctgtgcttaaatattataaggttgacgagaatggtaaaatcagcaggttgaggagggaatgcccctccgagcagtgcggtgctggcgtcttcatggctgccatggaggacaggcactactgtggaaagtgtgcctacacccttgtcttcaataagccagaagataaataa

SEQ ID NO: 209 - DNA, 582 bp, artificial sequence
  Nezara viridula
atggttaaccgaagggttccatctgtgcatagtaaaacctatgttactccaaggcgtccttatgaaaaggcccgtcttgatcaggaattgaggataatcggcgagtatggactgagaaataaacgtgaagtatggagggtcaaatatactcttgctaaaatcaggaaagctgccagagaattgcttactcttgatgagaaggatcccaagaggttgtttgaaggaaatgcacttttgcgaagattagtaaggataggagtattagatgaggctaaaatgaaacttgattatgttttgggtctcaaagttgaagatttcttggaaagaagacttcagacacaggtttttaaactgggtcttgctaagtcaattcaccatgctagagttttgataagacaaaggcatataagagtgaggaagcaggttgtcaatatacccagcttcattgtgaggttagactcacaaaaacacattgacttctcattgaaatcaccattcggtggtggccgccctggtcgtgtaaagaggaagaattctcgtaagggaactactgctgctgctgcagaggaagatgaagattaa

SEQ ID NO: 210 - DNA, 834 bp, artificial sequence
  Nezara viridula
atggctggtgttttagcaactgagagaactcttcctggcttttctttcgaaaattgtaaaaggaactccaccctattgcaacaaggatttaaacctcctactgcccagaagactggtacaactattgttggaatcgtatacagagatggtgttatccttggagccgatacgagagcaacagaaggtagcacagttgctgataagaattgctccaaaatacatttccttgctgacaacatctattgctgtggtgctggtactgctgccgacactgaaatgaccactatgacaataatgtcacaattggaattacatcgccttaatactgggcgcccagtcagagtttctactgccaagcagcttttgaaacaacttctcttcaggtatcaggggcacattggagcagctcttgtagttggtggtgttgacgtaaccggacctcttctttattctatacatcctcatggctcctctgagtgcttaccgtttacaactatgggctcgggatctcttgctgctatgacggtactcgaatcatcatggaagcccgatttgacggaagaagaaggtaaagtaattgtccgtaatgccattgctgctggtatattcaatgaccttggttctggaagcaacgtggacgtttgcatcatccgcaaaggttctgttgattatattcgcccctttgatatcgctaatctaaaaggacagaagcaaaataattatcgcttccgtcgaggcactacaggagttctttcaactagaataatccctttggtgacagaatcagaagaaataaagaaaactgaagtagaatcgatggatacatctgcttga

SEQ ID NO: 211 - DNA, 705 bp, artificial sequence
  Nezara viridula
atgggttctgagagatatagcttttctttgactactttcagtccatctggaaaattagttcaaattgagtatgcacttgccgcagtcgcagctggagctccatcaatcggtatcagagcatccaatggagttgtattggctactgaaaacaaatacaaatcaattttatatgaagaacatactattcaaaaagtagaaatgataactaaacacattggaatggtctacagtggaatgggacctgattataggctactagtgaagagagctagaaaaatggctcaacaatatcagttagtttacggtgagcctattcctactgcacagcttgttcaacgagttgccatggttatgcaggagtacactcaatctggaggtgttagaccttttggagtttctttactcattgccgggtgggatggggataaaccatctctgtttcaatgtgatccatctggagcatactttgcctggaaagctactgcaatgggaaaaaattttgtcactggcaaaacatttctagaaaagaggtacagtgaaactttagagctggatgatgcagtacatactgcaattctcactcttaaagaaaactttgaaggccaaatgacttcggacaatatcgaggtcggagtttgtgatgatcaagggttcagagttttagatcctacaacagtgaaggattatctggctaatattccataa

SEQ ID NO: 212 - DNA, 864 bp, artificial sequence
  Nezara viridula
atggctcctgctaaaaaaccagcaccagccgctaagaaggtgccgacaaccactgtcaccagtggtaaggctggcaaaaccgctgcagcttcttccaaggcagctccagcgccagctgctaaagcagctgcagccaaatcagcagctcccacttctgctaaaccatcagccaaacaacccgctccagctcctaaagccgctcagcccaaagcccaggcgaagcctgccgctcaacaacaaaagcctgctaaaccacagcagcaaacaaaaactgcagctccggctaaaggtcaagctaagcctgcagcccaggcaaagcccgctgctccagctgcagctcctaaacaacccgcagctccagctgcagcaggaactcaacctgccgcagcagcacccaagaaagctccttcaggtgcagttaaaaaagcaacaactgcgcccaaaaaaagtcaaaatttacagaagaagtcccaccaaggtgttaggaaacaagtgttaaaaggaaaaggacagaaaaagaaaaaagtatcattaaagtttataattgactgtactcatccatatgaagacaaaattatggacgtcgccaacttcgaaaagtatattcaagaaaggtttaaagttaatggtaaaaccaacaacttaggcaataatgttactttggaaaggaacaagatgaaaataactgttacttcagatgttcatttccctaagaggtacttgaaatatttgactaagaggtaccttaagaagaacaatttgagggattggctcagggttgtatctagttcgaaggatacctatgaactaaggtacttccagtttaatagccaggatgatgatgatgaagaggacaatgattaa

SEQ ID NO: 213 - DNA, 351 bp, artificial sequence
  Nezara viridula
atgaccaagaaaaggaggaatggaggaagatccaaacatggtaggggtcacgtgcaagcagtccgttgcaccaactgtgcccgttgcgtgccaaaagataaggctatcaagaaattcgttattcgtaatatcgtagaagctgcagctgtgagggatatcacagatgctagcgtttactcttcgtaccagttgccgaagctctatgccaaactacattattgtgtgtcatgtgctatccactctaaagtagtgcgtaatcgttctaaggctgagagaagaattaggacacctcctcagcgtaacttcccaagggatatgatgcgtcaaggtggaccccagataaggaagtaa

SEQ ID NO: 214 - DNA, 900 bp, artificial sequence
  Nezara viridula
atgggtttcgttaaagtcgtgaaaaacaaacaatactataaaaggtttcaagttaaattcaagaggcgacaactaggtaaaactgactattatgccaggaaaaggttgattgttcaagataaaaataagtacaatacaccaaaatatcgtttaatcgtccgtttttccaacaaagacatcacttgtcaggttgcttattcacgcattgaaggtgacaaaatattgtgtgctgcatacagccatgaacttcctcattttggaattaaagtaggattaactaactatgctgctgcctactgcactggtcttcttttggctaggaggttacttcagaaattgaagttggatgcactatatgaaggtacaactgaagtaactggtgatgaatacaatgtagagaacttggatgaaggcccaggagctttccgttgttatttggatgttggtttaatgaagaccagtgctggagcccgagtttttggggcattgaaaggtgctgttgatggaggtctcaacatccctcacagcatgaaaagatttcctggttatgattctgaaagtaaggagttcaatgctgaagttcaccgaaaacatatttttggaattcacgttgctgattacatgaggcagttggccgaatctgatgaagatgcttacaagaaacagttcagcatttacatcaaaaatgggattgttcctgatgctattgaagacatttataagaaggcacatgcagcaatcagagaaaatcctgctcatagaccacaagtaaggactaaggaagccatcaagaagagatggaatcgtgctaaacttacccttgccgaaaggaagaattgtattgcccaaaagaaagcagcatttttaaaaaagatgaaggccggtgatgttgatgcctaa

SEQ ID NO: 215 - DNA, 1317 bp, artificial sequence
  Nezara viridula
tcagataccattgaaaatgtaaaagccaaaattcaagataaggaaggaattccgccagatcagcaaaggctgatctttgcaggaaaacagttagaagatgggcgtactctttctgattacaacatccaaaaggaatctactttacatcttgtacttagacttcgaggaggcatgcaaatttttgtcaagactttaacagggaagaccatcaccttagaagttgaaccatctgatactattgagaacgtaaaagcaaaaatccaggacaaagaaggaattccaccagaccagcaacgtttgatctttgctggaaaacaacttgaagatggccgtaccctttcagattataatattcaaaaagagtctactcttcatcttgtacttcgcttgagaggtggcatgcagatttttgttaagacgcttactggaaaaaccataactttagaagttgaaccgtcagataccattgaaaatgtaaaagccaaaattcaagataaagaaggaataccaccagaccaacagaggcttatttttgctggaaagcagctggaagatggccgaactttgtctgattacaacattcaaaaggaatcaacactgcatttggtgcttcgtctaagaggaggcatgcagatctttgtgaagactttgacaggtaaaaccattaccttggaagtagagccatctgatacaattgagaatgtaaaagctaaaattcaggataaagaaggaattcctccagatcagcagcgtttgatctttgctggaaaacaactcgaagatggccgtaccctttcagattataatatccagaaggaatctactctacatctggtccttagattgagaggtggcatgcagatctttgtcaagacccttacaggcaagactatcaccttagaagttgagccatctgacactattgaaaatgttaaagccaaaattcaggacaaagagggaattcctcctgaccagcagcgtttgatctttgctggaaaacaacttgaagatggccgtaccctttcagattataatattcagaaggaatctactcttcatctagtacttcgattaagaggtggaatgcagatctttgtcaagaccctcacgggtaagactatcaccttggaagttgagccatctgacactattgaaaatgtcaaagccaaaattcaggacaaagaaggaatacctccagatcagcagaggcttatttttgctggaaaacaattagaggatggtcgtaccctatctgattataacatccagaaggaatcaactctgcatttagtgttgcgtcttaggggcggatattaa

SEQ ID NO: 216 - DNA, 594 bp, artificial sequence
  Nezara viridula
atggcggacgatgaggcgaagaaagctaaacaggccgagatcgagcggaagagagcagaggtccgaaagaggatggaggaggcctcaagaggcaagaaggccaagaaaggtttcatgacgccagacaggaagaagaaactccgacttctgctgaggaagaaagctgctgaggaactgaaaaaagaacaagaaaggaaagcagctgagagaaggaggatcattgaggagcgctgtggaaagatatgtgatgttgacaatgccaatgaagagaccctgaagaaaatctgccaagactatcacaagcggattgatgctttggaacgcagtaaaattgacatcgagtttgaagtggagaggagggattttgagattgcggatcttaacagccaagtcaatgatcttcgtggaaaattcgtaaagcccaccttaaaaaaggtttccaaatacgaaaataaatttgccaaacttcagaagaaggccgctgaattcaacttcagaaatcaactcaaagttgtaaagaagaaggagtttacccttgaagaagaagacaaagagcccaagaagtctgaaaaagcagaatggcagaagaaatga

SEQ ID NO: 217 - RNA, 290 nt, Nevara viridula
ugaaauggcuguuggucuuaaaaaaggucacaggacaaccaagauuguaaugggaaaguccaaagcugauaagaagcacaaaauuagaccaucacgccugaaagguagacaaaccaagcauacaaaguuuguuagagauuugaucagagaaguaugcggucaugcaccuuaugaaaagagaggaauggaguugcucaagauuuccaaggauaagagggcuuugaaauuuuugaagagaaggaucggcacucacauccgugcuaagaggaagagggaagaacuuagcaaca

SEQ ID NO: 218 - RNA, 641 nt, Nevara viridula
gacgcagauguacaaaaacaaaucaagcacaugauggccuucauugagcaggaggccaaugaaaaggcugaagaaauugaucaaaaagcugaagaagaauucaauauugagaaaggaaggcuuguucagaaucaaagauuaaagaucauggaauauuaugaaagaaaagaaaaacagguggaacuucaaaagaaaauccaaucuucaaauauguugaaucaagcucgacucaaagcuuugaaaauacgugaagaucauguucgcgauguacucgaugaggccaggaagagacuguugcaaucagucaaagacgaagcacguuacaaagauauccuugagaaacucaugcuucagggguuguaccaguugauggaaucagacauuuugguuagaacucgugaaauggauggcccaguugugagcucaguguucccugaugugcuggugaaauacaaggaaucaucagguaaggauuugcagcugaaguuggauacagaauuguacuuaccaucugaaugugcugguggcauugaacuuuacacugcgagaggccguaucaagauuguuaacacucuugaauccaggcuugaucuuauuucagcacaauuguugccucaaauuagaacauccuuauucggucg

SEQ ID NO: 219 - RNA, 319 nt, Nevara viridula
acucaagggauucagcaauuauuagcggcugagaaaagagcugcugaaaaaguugcugaggcgaaaaaacgcaaggcuaggcgucuaaagcaagccaaagaagaggcccaagaagaaauugaaagauacaagcaagacagagagaaacaguucagggaguuugaagcucagcauaugggcucacgagaagauguugcagcaaggauagaugcugauacacgccaaaagauugaagaaaugaaugaagcaguuaaugcuaacaaagaagcaguuauucaaagaauuuuggaauugguuuacgauaucagaccagagaugc

SEQ ID NO: 220 - RNA, 767 nt, Nevara viridula
gaaagaccaacugagcaguauucagacauuggugggcuagacaaacagauucaagagcuaauugaagcuguuguucuucccaugacccacaaagaaaaauuugaaaaucuuggaauucauccuccuaaagguguauuacuuuauggaccuccuggaacaggaaaaacuuuauuggcaagagcgugugcagcucaaacaaaaucuacuuuucugaaacuugcugguccccagcuaguacagauguucauuggggauggagccaaacuuguuagagaugcuuuugcucuugcuaaagaaaaaucuccagcuauuauauuuauugaugaguuggaugcuauugggacaaaaagauuugauucugaaaaggcuggugaucgagaaguucaaagaacuauguuagaguuacucaaccaguuagauggauuuaguucaacagcugacauaaagguuauugcugcuacaaauagaguagauauuuuggauccugcccuuuugcguucuggacgacucgauaggaaaauugaauucccacauccuaaugaagaugcuagagcacguauaaugcaaauacauucccguaaaaugaauauuaguguagaugugaauuuugaagaacuugcucguucaaccgaugauuucaauggagcucaguguaaagcuguuuguguggaggcugguaugauagcuuugcgucgaggagcuggaguaguuacccaugaagauuucauggaugcaauauuggaaguacaagcaaagaagaaagccaa

SEQ ID NO: 221 - RNA, 344 nt, Nevara viridula
ccucacggguaaaaccauuacccuagagguugaaccuucugauacuauugaaaaugugaaagcuaagauucaagacaaagagggaauuccuccagaucagcagaggcuuauuuuugcugguaaacaauuggaagauggaagaacuuugucugauuacaacauucaaaaagaaucuacucuucauuugguccuucgucugagggguggugucauugaaccaacucucaaaauucuugcacagaaauacaauugugacaagaugauuugccgcaagugcuacgcuaggcuucacccgagggcaacuaacugccgcaagaagaaaugugggcauaccaacaauaucc

SEQ ID NO: 222 - RNA, 718 nt, Nevara viridula
gaaccaaacagagaaaaggcuuuacaagauuaucguaaaaaauuacuggagcauaaagaaguugaagucagacuuaaagaaaugagagaccaguuaaaagaucuuaccaaacaauaugauaaaucugaaaaugacuugaaagcccuucaaaguguuggucagauuguuggagaaguauuaaagcagcuuacugaagaaaaauuuauugucaaggcuaccaaugguccaagauauguuguugguuguagaagacaacuugauaaauuaaaacuuaaaucuggcacgaggguagcauuggacaugacaacuuuaacaauuaugcgacauuugccgagagaaguugauccauuaguguauaacaugucucaugaagauccaggagauguaacauauucugcuauuggaggucuugcagaacaaauuagagaacuucgugaggugauugagcugccucuguugaauccugaacuuuuucaacgaguugguauuacuccaccuaaaggaugucuacuuuacggcccuccugguacuggaaagacuuuguuggccagagcuguagccagccaauuagaugcaaacuuccuuaagguagucuccagugcuaucguugacaaauauauuggagaaagugcucgucuaauuagagaaauguuuaauuaugcaagagaucaccagccuugcauaauuuuuauggaugaaauugaugcuaucggagguc

SEQ ID NO: 223 - RNA, 701 nt, Nevara viridula
agugcguucuuugguagauuauuucuuggaucuugaagcuggaauaggaauagaaguucaacuuuguaaagaguguaucgaaugggcuaaagaugaacacaggacuuuucucaggcagucacuggaagcuaggcuuaucgcucuauauuucgacacaggaauguuuacagaagcacuacagcuuggcucaagucuucuuaaagaauuaaagaaauuagaugauaaaaauuugcuuguugaaguccuuuuguuggaaucuaaaacuuaucaugcuuugagcaaccuuucaaaagccagggcugcuuugacaucagccaggacaacugcuaauuccauauauuguccacccaaaaugcaagcagcccucgauuugcaaucugguauauuacacgcagcagaugaacaagauuucaaaacagcuuacucauauuucuaugaagcuuuugaaggcuaugauaguguagagagcccaaaggcuuuaguugcucuuaaauauaugcuucugaguaaaaucauguuaaacacaccagaagacgugcagcaguugguuagcgggaaacuugcucuuaaacaugcugguaaagauauugaugcaaugaaaucaguugcucaagccagccauaagagaucacuugcugauuuccagcuaacuuuaaaaaauuacaagaaagagcuugaggaagauccaauuguacgagcuc

SEQ ID NO: 224 - RNA, 432 nt, Nevara viridula
gugauuuguuuucacgugguuacaggaaacauggugucaucccacuuucgacguacaugaaaguauacaaaguuggagauauuguaucgauuaagggaaauggugcuguucaaaaggguaugccccacaaaaguuaucaugggaaaacaggacgaguuuacaauguaacuccuagagcuuugggugugaucgucaacaaaaggguccguggaaaaauucuaccuaagaggauuaacauccguauugaacaugucaaccacuccaagugccgugaagauuucuugaagcguguacgagaaaaugagaggcucaggaaagaggccaaagaaaagggcauucauguugaauugagaagacagccugcccagccacgaccugcucauuugauaacugucaaagagccuccaauaaugcucgcuccuauaccuuaug

SEQ ID NO: 225 - RNA, 625 nt, Nevara viridula
acuggucuccauguuguuuucuuucaguguggaacuucgggauuaccaugaguucguugaaguuacagaagaggcuagcagccucuguuaugagaugugguaaaaaaaagguuugguuagacccaaaugaaauuaaugaaauagccaauacaaauucaagacaaaacaucaggaaguuaaucaaagaugguuuuauuaucaagaaacccguugcaguacauuccagggcccguguucguaaaaauacugaagccagaaggaaagguaggcauugugguuucgguacaaggaaagguacugcuaaugcaagaaugccagcgaagguguugugggugaacagaaugaggguucuuaggcgguuacugaagaaguauagagaagccaagaaaauugauaggcagauguaucaugacuuauacaugaaagcaaaagguaauguuuuuaaaaacaagcguguauugauggaauuuauucauaagaagaaagcugaaaaagcuagguccaaaaugcuccgugaucaagcugaagccaggaggcaaaaaguuaaagaagcaaagaagcggcgagaagaaaggaucacaaugaagaaacaagaaauauuacaaucuuaccagagggaagauga

SEQ ID NO: 226 - RNA, 610 nt, Nevara viridula
gaguaucgaggaagcucuucguucacguuaccguguuucuacaagccuucauucgcaaugggggcuuacaaguacauccaggaauuguacagaaaaaagcagucagaugccaugagguaucugcugcgaaucaggguuuggcaauacagacagaugaccaagaugcaccguguugugaagccuucaagacccgauaaagcuaggagauugggauuuaagaauaaacaagguuucuguguauucaggauccguaucaagcgaggaggcaggaaacgcccaguuccaaagggugcuaccuauggcaaaccuaaaagccauggaguaaaccaguugaaaccuacaagaagucuccaugcuauggcugaggaaaaaguugguaggaagugcaguggauugagaguauuaaacucuuauuggguagcccaagacgccagauacaaauacuacgaagucaucugcguugacccagcucacaaggcaaucagaagagaugcuaaagccaacuggauaugugacccagugcacaagcaccgugagaugcgugguaagacuagcgcugcuaggaagucacgaggucuuggcaagggccacagauacucacagaccaagg

SEQ ID NO: 227 - RNA, 734 nt, Nevara viridula
cccaauugaacacgguauuguaacuaacugggaugauauggaaaaaauuuggcaucacacuuucuacaaugaacuucgaguugcgccagaagagcacccaguucuccugacugaagcaccuuugaaccccaaagcaaauagggaaaaaaugacacagaucauguuugaaacauucaacacuccagcuauguauguugccauucaagcuguucugucccuguaugcaucuggacguaccaccgguauuguucuggauucuggagauggugucucacacacuguaccaauuuaugaagguuaugcucuaccucaugccauccuuagguuggauuuagcuggacgugaccucacugauuaccucaugaagauccugacugaaaggggauacuccuucacgacuacugcugagagagaaauugugagggauaucaaggaaaaauuguguuauguugcucuugacuuugagcaggaaauggccacugcugccaguucaaguucccuagaaaaaucuuaugaacuuccugauggacaaguuaucacaauuggaaaugaaagguuccgaugcccugaagcucuguuccagccuucuuucuuggguauggaggcaugugguauccaugagaccacuuacaacucaaucaugaaaugugaugucgacauuaggaaggacuuguaugccaauacuguucucucuggagguacuaccauguacccugguauugcugauaggaugc

SEQ ID NO: 228 - RNA, 754 nt, Nevara viridula
acauggaaaagaucuggcaucacaccuucuacaacgagcugcgagucgcuccagaggaacaccccauccuccucaccgaggcuccccucaacccuaaagccaacagggagaagaugacccagaucauguuugagaccuucaacaccccagccauguaugucgccauccaggcuguacucucccucuaugccuccggucguaccaccgguauuguacuugacucaggagaugguguaucccacaccguacccaucuaugaagguuaugcccuuccucacgccauccuccgucuggaucuugcuggacgugacuugacugacuaccuuaugaagauccucaccgaacgugguuacaguuucacaaccaccgcugaaagggaaaucgucagggacaucaaggaaaaacugugcuauguugcccuggacuuugaacaggaaauggccaccgcugcugccuccaccucccucgagaagucuuaugaacuuccugacggucaggucaucaccaucgguaacgagagguuccguugcccagaggcucucuuccagccuuccuucuuggguauggaaucuugcgguauccaugagacugucuacaacuccaucaugaagugcgauguugacaucaggaaggacuuguacgccaacaccguccucuccggagguaccaccauguacccagguauugcugacaggaugcagaaggaaaucaccgcccucgcuccuucaaccaucaagaucaagaucaucgcucc

SEQ ID NO: 229 - RNA, 799 nt, Nevara viridula
aucaucaacguacacuagcccuguugucgaaacuauugaucugccuaaaccuacauacacaccugcgaaaccugucuuaacagcgaaagcuaugaaacuaggugguaaaucuagagaugucgaaucauuuguugaucaacuaaaaucagagggagaaaaugugauuucacaaguggcugcgaauaaaccuguugcagcuaaguuagccucuacaccaaauauucauauggaagagguccaucuaaaacaggaagaaaaacuaaugguuucuguaggaaaggaugguggaauacaaagcuuugagcuccaugguuugguaacauuacggauaacugaugaaaaauaugcuaagauaaaaguauaucucgauaacaaagauaagagaggaauucaguugcagacgcauccgaacguggauaaagaauuauucaaaaugaagucgcagauugguuugaagaauccuucaaaaccauuuccuuuaggaacugauguagguguacuuaaauggcgauaccaaucucaagaugaaucugcacuuccucuaaccauaaacugcuggccaucugaaaauggacaaggaggaugugaugucaauauugaguaugagcucgaacauucucaccuugaacuaaaugauguuaccaucaacauuccauuaccuauugggugcucuccuguuguugcugagugugauggcgaguacaaacacgagucccgaaggaacuugcugcaauggguacugccaguuauugacaggaguaacaaaucaggagcgauggaguuuucgacaucuucugcu

SEQ ID NO: 230 - RNA, 722 nt, Nevara viridula
guguuaggggucaugauguuauugcccaagcucagucagguacugguaaaacagcuacauuuuccauuucaauauuacaacaaauugacacuagugcaagagaaugccaggccuugauuuuggccccaacucgugaauuggcccaacagauccagaaaguagucauagcccugggagauuuuaugggggccaugugccaugcaugcauuggugguacaaauguuagagaagacaugcgcaaacuagaaauggguguucauguuuugguuggaacucccggacgaguuuuggauaugauuagccgcagagcucuaaaaacuaacaccauuagaauuuuuguguuggaugaagcugaugagaugcuuucucgugguuucaaagaucagauccaugauguauuuaaaaauuuaaaucaugaaguacagguuauauugcuuucagcuacuaugccaucagauguauuggaggucaguacaugcuucaugaggaauccuauucguaucuuaguuaaaaaagaagaacuuaccuuggaagguaucaaacaguuuuuuguuuuuguugagagagaagaguggaaguuggauacucucugugauuuguaugaaacacuaaguauuacucaagcuguaauuuuuuguaauacaaggcgcaagguugauugguugacugagaguaugcauaauagagacuucacuguuucugcuaugcacggugauauggaa

SEQ ID NO: 231 - RNA, 700 nt, Nevara viridula
gcguuuaaaugcuccaaaaucauggauguuggacaagcuuggugguguuuuugcgccaaggcccagcucagguccacacaaacuuagggaaucauugcccuuaguaauuuuucuccguaauagacuaaaguaugcacuuacaaauacugaaguaacuaaaaucgugaugcagcgucucauaaaaauugauggcaaagugaggacagacccuaacuacccugcagguuucauggaugugauuagcauugagaaaacuggugaauuuuuccgauugaucuaugauguuaaggggcguuaugcuauucacagaauuacugcugaugaagccaaguacaagcugugcaagguuaaaagggugcagacugggccuaaggguauuccuuacuuaguuacccacgacgcuagaaccaucagguacccagauccacucgugaaaguucaugauaccauucagcuugauauugcuacuggcaaaaucaucgauaucauccgaauggagucagguaaccuuugcaugauuacuggaggucguaacuugggaagaguugguacuguuguaaacagggagagacauccuggauccuucgauaucguucauaucaaggaugccaguggccacaccuuugccacacgguugaacaauguguucaucauugguaaggguagcaaagcuuacguuucauuaccuaaaggcaagggu

SEQ ID NO: 232 - RNA, 702 nt, Nevara viridula
auuguuauggcugcuaccaacaggccuaauucaauugaugcugcucuuagacguuucggacgauuugaucgugagauugauauugguauuccagauacuacuggacguuuagaaguucuucgaauucacacaaaaaauaugaaacuugcugaugauguuaauuuagaacagauugcagccgaaacacauggucauguuggugcugauuuagcaucucucuguucagaagcagcucuucaacagauucgugaaaaaauggaucuaauugauuuagaagaagaccaaauugaugccgaaguucuuaauucucuugcuguuaccauggauaacuucagguaugcuaugggcaaaaguagcccuagugcccuucgugaaacagugguugaaguuccuaauauuacuugggaugauauugguggucucgauaauguuaaaaaagaguuacaagaauuaguucaguauccuguugaacauccagagaaguucuugaaguuuggaaugcaaccuucccgugguguuuuguuuuauggaccaccagguugugguaagacuuuguuggccaaagcuauugcuaaugaaugccaggccaacuucaucucgguuaaggguccugaauuauuaacuaugugguuuggagaauccgaagcuaauguccgugauauuuuugauaaggcuagagcugcugcaccauguguucuuuuu

SEQ ID NO: 233 - RNA, 335 nt, Nevara viridula
acuauugaagacgaaucgggcccaucuggcgacucaguggacauaaauaccgcucuuaaagaaguacuaaaaggaguugugagaaauggagucauaguacauggucugagggagucagcuaaagcucuugacaagcgacaggcauuacuguguguucuggccgaaaacugugaugagcccauguacaagaagcuugugcaagcucucugcucagaacaucaaauaccauuaguuaaggucgacuccaacaaaaaauuaggagaaugguccgguuuauguaaaaucgacaagacaggaaacccaaggaaaguuguugggugcucuuguguaguuau

SEQ ID NO: 234 - RNA, 379 nt, Nevara viridula
auagcagaaggaugucuggacguggcaaagguggcaaagccaagggaaaggcaaagacccgaucaucuagggcaggacuccaguuccccgucggucguauccaccgucuccucaggaaagguaacuacgccgagagggugggagcaggagcuccgguguaccucgcagcagucauggaauaccuggcugccgaaguucucgaguuggccggcaacgcagcucgugauaacaagaagacuaggaucaucccgcgucaucuccagcucgccauaaggaacgacgaggaguugaacaagcuguugucgggagucaccaucgcucaaggcggaguacuucccaacauccaggccguucugcugccgaagaagacagagaagag

SEQ ID NO: 235 - RNA, 729 nt, Nevara viridula
cucacaguguaucagcuaccgucaauguuacugucaaagaaauaccagaagaagcuguugauaagucagguucuguucguuuaguuggaauuacugcugaagaauuuauagaagcuaauucuaaugguaucagcaagagaacuauguucaggaaauauuuagcaaaauucuugaacauuacugaagaaaauguugauguguuuacuguuuuacauucuccacacaauacaaauacaagucuacuggauguucgauuuucagcucaugguucuccuuauuauaguccagaaaaacugaaugcagcagugagcgugcauaaugcugaauuggagaaagagcuuggaguugcgauucucauggugaacauagaugaaugucucauugaaaggcaguacugugaggguucauguauuaauuuucugaauaaaagucgugagccgaucgccguuuacacuaauacaacaacuuuuguuggugugagagcuguuguagauccuuuuuguaauugugagguacuuucaaggccaguuuguuauaauggugguacacuuauuaacgacaagugugaaugugaaccuggcuuugaaggaccucauugugagauccuaaguguuggauuuaauggaaauggaugggcccuuuauccuccauuagaaucuugugcugauucacaucugucuuuggaacuucguuccaauaaaaaggauggucuuguguuuuaccuagggc

SEQ ID NO: 236 - RNA, 702 nt, Nevara viridula
agccucaaaagaagacugagggcgauggagauccagaauuuguaaaacgccaggaagcuaaaacaucagcuuuggaugaacaacucaaggacuacaucgcagaauggagaaaacaaagagcgaaagaggaagaggaccugaagcgccucaaagaaaagcaagccaagagaaaggucaugagagcugaagaagaaaagaggcucgcugaaaagaaaaagcaagaggaagaaaggcgagucagagaagcugaagaaaagaaacagagagauauugaagaaaagaggcguagacuugaggaagcagaaaaaaaacgacaggcuaugauggcagcucuuaaggaucaaaguaaaagcaaggguccaaacuucacaaucagcaaaaaggaagcuggucuaaacuugucuucagcacaaauagaaaggaacaaaacaaaggaacaauuagaagaagaaaagcguauuucccuuagcauaaggauuaaaccauuaaguauugaaaaucuuaacauugacagauuacgauuaaaagcuauugaacucugggauugcauuguuaaacuggaaacugagaaauaugaucuugaggaaagacaaaaacgucaagauuaugaucuuaaagaacugaaggagagacaaaagcagcaacugaggcauaaagcacugaagaaagguuuagacccagaggcuuugacuggcaaauauc

SEQ ID NO: 237 - RNA, 792 nt, Nevara viridula
ucaagaagaagaugcaagcuaugaagcuugagaaggacaacgcgauggaucgcgcccuccugugcgagcagcaggccagggaugccaaccugagggcagagaaggcugaggaggaggccagguccuugcagaagaagauccaagccauugagaacgacuuggaccaaacacaggagcaguugaugcaggucuugcagaagcuugaggauaaggauaaggcucuccaaaacgcugagagcgaggucgccgcccucaacagacguauccaacuguuggaggaggaccucgaaaggucugaggaaagauuggccaccgcaacagcuaaacuggccgaagccucccaagcagcagaugaguccgaaaggcagagaaagguucuugagaaccgcagcuuggcugaugaagagcgcauggacgcacuugaaaaucagcugaaagaagccagauuucuggcugaagaagcugauaagaaauaugaugaggucgcucguaaauuggccaugguugaggcugauuuggaaagagcagaagagagagccgagagcggugaaucaaaaauuguagaacuugaggaagaacuccgcguuguugguaauaacuugaaaucacuggaagugucagaagaaaaggcaaaccagagagaagaagaguacaagaaccaaauuaagacccuuacaaacagacuuaaggaggcugaagcucgcgcugaauucgccgagcguuccguucagaaauugcagaaggaaguugacaggcuggaggacgaacuuguccacgaaaaggagaaguaca

SEQ ID NO: 238 - RNA, 714 nt, Nevara viridula
auaagggacucuccaaaggaggaaagaagggaguuaagaagaagguaguugacccuuucacaaggaaggauugguaugauguuaaggcuccaucaauguuuaauacccgucaaaucgggaagacucuugucaacagaacacaaggaacuaaaauugcuucugaaggacucaaaggucgaguuuucgaggugagcuuagccgaucuucagaaugauacugaugcugaaaggucauucagaaaauuccgucucauugcugaagauguucagggcagaaauguuuugaccaauuuccaugguauggacuugaccacagauaaacugaggagcauggugaaaaaguggcaaacauuaaucgaagccaauguugauguuagaaccacugacggauacuuguugagaguuuucuguauuggauucacuaacaaggaccagaugucucagcguaaaacuuguuaugcccaacacaaccaggucagagcuauuaggaaaaagaugguugacaauauuacaaacaacauuaguaacagcgauuugaggguuguggucaacaaauugauccccgauuccauugcaaaagacauugaaaaaauaugccaaggcaucuauccucuucaugaugucuacauuaggaagguuaagguacugaagaaaccaagguuugaguugagcaaacuucuugaacuucauggugaugguaaaggcucugaugaac

SEQ ID NO: 239 - RNA, 564 nt, Nevara viridula
cucgguguuaucguuacuguaaaaauaaaccuuacccuaagucaagguuuugucguggugugccagaucccaagaucaggauuuuugaucuuggaaagaaaaaggcucguguugaugauuuuccauuauguguacaucuuguuucugaugaauaugaacaacuuucaucagaagcucuugaagcaggacguaucugugcaaauaaauauuuaguaaaaaauuguggaaaagaucaauuccacaucagaaugagauugcaucccuuccaugucaucaggauaaacaaaauguuaucgugugcuggagcugauaggcuccagacugggaugagaggugcuuuuggaaaaccgcaggguacuguagcuagaguacacaucggucaaccuaucaugaguguccguuccagugacagauacaaggcugcugucauugaggcacucaggagagccaaguucaaguuuccaggaaggcagaagaucuauguuucuaagaaaugggguuucaccaaguaugaccgagagacauuugaggaacugagggcugauggaaaauuggcgaaugaug

SEQ ID NO: 240 - RNA, 649 nt, Nevara viridula
agagccgaauugaaugaguuuuuaaccagagaacuagcugaagaagguuauucugguguugagguccgugaaacuccuagcaggacugaaauuauuauuauggccaccagaacucaaaguguucuaggagaaaaaggaaggcguauuagagaauuaacuucaguugugcaaaagagauuuaacuuucagccacaaucuuuagauuuauaugcugaaaaagucccaacuagagguuuaugugcuauugcucaagcugaaucuuugagguacaaguugauagggggucuggcuguccguagagcuuguuauggaguucugagauucaucauggaaaauggagccaaagggugugaaguaguaguuucaggaaaacuuagaggccaaagagcuaaguccaugaaauuuguugauggccuuaugauccacaguggugacccauguaaugaauauguaaauucagcuacccgccauguauuauugagacaaggaguacuugguaucaaaguuaaaauuauguuaccaugggauccaacaggaaagaauggaccuaagaauccucugccugacaacguuuguguugucaauccuaaagaugaaauuauuccuucugauauuaagacuaugggaaucgaauuacauccaccagcua

SEQ ID NO: 241 - RNA, 282 nt, Nevara viridula
caaggcagaauuagcuuguguauacucugcacucauccucgccgaugacgauguugccguaacuggagagaaaauccaaaccauccucaaagcagccagcguugacauugagcccuacuggccuggccucuucgccaaagcccuugaagguaucaacgucaaggaccucaucaccaacaucagcagugguguagguguuggcgguggugcuccagcagcugcugcaggcggugcugcacccgcugcugcugcugcuccagccgguggugacaagaagaaaga

SEQ ID NO: 242 - RNA, 584 nt, Nevara viridula
aguuuuccuuggcaaaaaggaagaaaaagcacccacagcuucugaagcuauacaaaagcuucgcgaaacugaggauauguuaauuaaaaagcaggacuuuuuggaaaagaaaauugagucugaauuaggucuugugaagaaaaaugguacuaguaauagaagaguugcaauucaagcucuuaaaagaaaaaagagguaugagaaacaauugcaacaaauugaugguaccuuggcuaccauugaaaugcaaagagaagcuuuagaaggugcuaauacuaauacagcuguccuucagacaaugaaguuugcugcugaugcauuaaaaaccgcccauaaacacauggauguugaccaaguucaugauaugauggaugaaauugcugagcaacaagaugucgcaaaagaaauaucggaagcuauuucuagcccugucgcuuuuggaaaugacauugaugaggaggaacuugaaaaagagcuagaggaauuagaacaagaagaauuagacagagaacuucuugguacaggcccgacugcagaucaauuaccugaugucccugccacucaauuaccugcaaaaccaaagc

SEQ ID NO: 243 - RNA, 365 nt, Nevara viridula
uauaucccagucugcuuugccauaucgucgaucaguuccaacuugguugaaacuaucaccagaagaugugaaagaacagauuuucaaauuaggaaaaaagggacucacuccuucacaaauaggugucauucuucgagauucccaugguguagcccaaguacgauuugucacuggaaacaagauucuccgaaucaugaaggcuaugggacuagcuccugaucuuccagaagaccucuauuuucugaucaagaaggcuguugcuaucagaaagcaucuugaaaggaacaggaaggacaaggacuccaaguuccgccuuaucuugguagaauccaggauucacagacuugcucguuacuacaaaacca

SEQ ID NO: 244 - RNA, 706 nt, Nevara viridula
auacuaaaaccaagcaggcaacaaucuucuuacaucgcaucaaggcuuggacagauauucagaagguauacaagucuaaaagguuccgugcugguaaagguaagaugcguaauaggaggcgcauucagcguagaggaccucucauuaucuacggccaggaucaaggccuaacucgugcuuuucguaacauuccugguguugaucuuaucaacguuucacgauuaaacuuacuuaaacuggcaccugguggucacguggguagguuuguaaucuggacccaaucagcuuuugaucaacuuaaugcucucuauggcacauggaagaaaaaaucaacuuugaaaaaggacuacaacuugccaaugcccaagauggugaauacugaucugucccgacuuuuuaagucugaagaaaucaagaguguccucaaaccuccaaggaagaccauagucaggaggguaaggaaacugaacccauugaggaauacacgagcaaugcugaagcucaacccauuugcugcuguucugaagaggaaagcuauuuuggcugacaggaaacuuaagcuugagagggcuauugagagaucaaagaaggaaggaguugagcuuaccccucaucaaaagagguauguugcuaugcuugagagaaggaaagcucagaucaaagccgccaaggcugcuaagccuaaaaagguuaagaagccuaaggc

SEQ ID NO: 245 - RNA, 539 nt, Nevara viridula
cuacuggguagacuuucagcuauuguagcuaaagcugcuuugaauggaaacagggucguuguuguuaggacggaacaaauuaauauuucaggaaacuucuucaggaguaaacuaaaguacuuaucguuuuuaagaaaaagauguaauguuaauccagccagagguccuuuccacuuccgggcacccaguaaaauuuuguauagaaccaucagggguauggugccacacaaaauugaaaggggaaaggcugcuuuaaggcguaucaaguuguuugagggaaucccucccccauaugacaaaaggaagcgaguaguagucccaacagccaugagaguuuugugcuuaaaaccugguagggcuuauugccaucuuggcagguuaucuucugaaguuggcuggaaguacaaggauguggucagggcccuugaaaccaagaggaaggucagggcaguuuuugauauucgcaagaggaauucccucaagaaauugacuaaacaagccaaggaaaagauguccaaagcgaaugcuaauuauaccgc

SEQ ID NO: 246 - RNA, 703 nt, Nevara viridula
aggauaaacugcaacgucuuguuaaacacccgcaaacaaccggcugguccggcgguagcguccacaccgcugcggcgucgcccggccauagcaggcaaggcaggagcccugguuauaacuccgcagcccacaugugggacucugcgucauccgaucccguacucucggacauccucgaucaagucaucgagauaguaccagauguuaacacagaugcgccagcucugaugaauaugaucaacucguuggaagcugagacucagcagucuguucaacaacaguucguaucucaaacagauuugaaugaaaagauggcgauuagcgcuauacaaaagucuuuaaugcucugcgaaucggcgguuaaagggccuucuuaucaaggaacgaugucgcaggguucuccaggaccacaaccccagccucaacagcaaccacaaccacaacagcaaccucagccgcagcagcaacaauuucacccuccuccgauguaucagcaaaggcagagguuuccuauccagcagcaacaacagauucgaagccaguucccccucaguccaaugauuauggcucagaggaguaaaaugcaacagcagcagcagaugcaacaaaagcagcgauuacuccacaugcagcaacaacaacagcuuguuauuccgucgaaugcgacugccucaaauaaugaccccgcacuccauaauauuga

SEQ ID NO: 247 - RNA, 313 nt, Nevara viridula
ggugcugagugguagauaugcuggaagaaaagcaauugugcuuaaaacuugugaugaaggaacucaagagaaggcauaugggcaugcaauaauugcaggcauugaucgcuauccccgcaaaguucauaagagaaugagcaaaacaaaaauccacaagaggucuaagaucaagccuuucuugaagguuaugaacuacaaccaccuuaugcccacucguuacacaguaucugagaucgccccugaccagaagguuguuacgaaagauuugaaggacccaaugaagaagaagaaaauacguuuccaaguuagggug

SEQ ID NO: 248 - RNA, 412 nt, Nevara viridula
gcuuacuagagcugcuaagguauuggaacaacuuacaggacaacaaccuguauuaucaaaagccagauacacugucaggucuuuugguauccgucguaaugaaaaaauugcuguacacugcacaguaaggggagccaaagcugaagaaauuuuagaaagaggcuuaaaaguuagagaauaugaauugagacgugauaacuucucugcaucuggaaacuuuggauuugguauucaggaacacaucgaucuugguaucaaauaugauccaaguauagguauuuacggucuugacuuuuacguaguauuaggaagacccggauucaacguagcccacaggaggucaaagacugguaaaguuggauucucacacagauugacaaaagaggaugccaugaagugguuccaacagaaa

SEQ ID NO: 249 - RNA, 728 nt, Nevara viridula
aacaagaacuuaccgaugcucacgaacaaaucaacgaacucgcagcucaagccacaagcgcuucugcugccaagcgcaagcucgaaggagaguugcagacacuccaugccgaccucgacgaacuucucaacgaagccaagaacucagaagagaaggcuaagaaggcuaugguugaugcugcgagguuagcagaugaacucagagcugaacaagaccacgcccagacccaagagaaacuccgaaaggcccucgagacacagaucaaggaacuccaagucagacuggacgaagccgaaaacaacgcccucaagggaggcaagaaggccauugccaaguuggaacagagagucagggaacucgaaaacgagcuugauggagaacagaggagacacgcugacgcccagaagaaccuccgcaaaucugagcgcaggauuaaggagcucagcuuccaaucugaugaagauaggaagaaccacgaacgcaugcaagaccuuguagacaaacuccaacagaagaucaagacuuacaagaggcagauugaagaagccgaagaaaucgcugccuugaaccucgccaaauuccgcaaagcccaacaggaacuugaagaagcugaggagagagcagaccuugccgaacaggcuguuacaaagcugagaacgaaaacuggcggcagagcuggaucaacugcaagagccaugagcccagugggccagaaacaaaggagagua

SEQ ID NO: 250 - RNA, 688 nt, Nevara viridula
ggaacuggguaugaucugucagcgucacaguuuucuccugaugguagaguuuuucaaguugaauaugcacaaaaagcuauugaaaauagugggacugucauaggucugcgaggcaaagaugguguuguuuuagcuguugaaaaguuggucacaucaaaauuauaugaaccgggugccaauaaaagacuuuuuacuauugacaaacacauuggaauggcuguagcaggucugauuucugaugcuagggcaguugcagaaguugcaaggacggaagcugcuaauuacagaucucaauacaagagcaguauaccucuuaaauacuugaaugagcgagugucuauguauaugcaugcuuauacacucuacagugcuguaaggccauuugggugcagcguuauacucagcacuuacacagaagaagacgguccagaaauguauaugauagauccaucaggaguuucauaugguuauuuugguugugcuguugggaaggcgaagcaagcugcaaaaacugaaauugaaaaauuaaaacugaaagauaugucaugucaggagcuggugaaggaagcagcccgaauuauuuaccuuguccaugacgaauuaaaggacaaacaguucgagcuggagaugagcuggauuggcucucagacaagugguguaaaucaacaagucccugcuaauguucaug

SEQ ID NO: 251 - RNA, 712 nt, Nevara viridula
ccucagcguaggaauuacaaucuugguuccggaguuuacagguuuagcagaacucgcauguuucauaagaaggccuuguggaaauuuauugguaagaaaaccccuaagaccccacgucccaaaaggaaaacuacucuugaaaaaaaaauugguggugagaagaauggagguacucguacugucuauuuaaagaagaggacaaaaucuuauccuaccacuaacaaggugagaaaacacccaagcaaaacauauuuuucucagcacaagagacgauuccgugcaucacuaaaacccggugcuauugugauucugcuugcuggacugcacaaaggaaaaagggcaguacuuuuaaaaaauauggcuaguggacuucuccuuguuucugguccauucucuuugaauggaguaccucuuagaagaauacaucccaacuauguuauagccaguucaacucaaauugaucugucugguguuaaauugccugagcauaugaaugauagguacuucaagagaguuaaagcaaaaaaggccaagaaaacugauggugaaaucuuugcugcuaaaaaagaaaucuacaaaccauccgaacagaggaagaccgaccagaaagagguagacaaacagauuuugcaggcuauuaagaaacaugaacauagucuacuucuaaggaaguaccugugcacaauguuuggccuucgaagcagucaguauc

SEQ ID NO: 252 - RNA, 715 nt, Nevara viridula
ccaaagacaaauugcccauuuucccuucucgaggugcucagacuuugaugaaaggaagacuugugggugcacaaaaaggucacaguuuguuaaagaaaaaagcagaugcccugcaaauuagguuuaggaugauccucagcaaaauuauugagacaaaaacucugaugggagaagugaugaaagaagcagcuuuuucauuggcugaagcaaaguucgcuacuggagauuuuaaccaacaaguuuuacaaaauguacagaaagcucaaauaaaaauuagaacaaagaaggauaauguugcaggugugacacugcccguuuucgagagcuaucaagauggaacagauuccuaugagcuggcuggauuggcuagaggaggacaacaguuagcgaaacuaaagaagaauuaucaaaaggcgauaaaacuucucguagagcucgcuucauuacaaacaucuuuuguuacgcuagaugaaguuaucaagcuuacgaacagaagaguuaacgcuauugaacacguuauuauacccagaauugaacgcacacuucaguauaucauuuccgaauuggaugaguuggaaagagaagaauucuauagauuaaaaaagauucaagauaagaaacguaucgcucgucaaaaagcugaagcaaagaaagcaguggacgcugccgcagcaacgauggcgagcaacauucucgaagaaaacgaugaggaccu

SEQ ID NO: 253 - RNA, 602 nt, Nevara viridula
ugaucccuaauggccauuuccauaaggauuggcaaagauuuaucaagaccugguuuaaucaaccugcucgcaaguaucgccgaagaauaaagagggucaagaaagcuagggccuuggcuccaagaccagcaacuuuacugcguccugcuguuaggugcccuacugugcgauaccacacaaaauugagggcuggcagaggcuucacauuagaagaaauuaagaggguuggauugugcccuggauuugcgagaucuaucgggauugcugucgaucacaggagaaggaacaagucagucgagucuuuacaauuaaauguacaacgucugaaggaguaucaagcuaagcuaaucuuguucccaaccaagaagagcaagaaggugaagaagggagaggcuucggccgaagaacaagcuuuagcuacccagguaucuucaccugugaugccgaucaagcaaacuguuguaaaauauaaagccagaacuauuacuccugaggauaagagcuucucugcuuauggagcuuuaagaaaggcaagggcugaugugagacuuguuggaaucagagcuaaaaggcuaaaggaagcagcugauaacccugaaacu

SEQ ID NO: 254 - RNA, 453 nt, Nevara viridula
gacaaugauggacacaggauauuagcaaaauacuaugauccaagugucuuuccaacuucuaaggaacaaaagggauuugaaaagaauuuguuuaacaagacucaucgagcuaaugcagaaauaauuauguuggauggacuuacauguguuuauaaaucuaauguugauuuauuuuucuauguuaugggaaguucacaugaaaaugaguugauauugaugaguguacuucaaugccuuuaugauucaauaagucaaauauugagaaaaaauguugaaaaacggacucucuuagaaaauuuagaaauuguaauguuagccauggaugaaauuugugauggaggaauaauauuagaagcugauccaacgaguguuguucaaggaguagcuuugaggacagaugauaucccacuuggugaacaaacuguugcucagguucuucagagugcaaaggag

SEQ ID NO: 255 - RNA, 470 nt, Nevara viridula
ccuguuuggcaaaaaggaaaugagaauacugaugguuggucuugaugcugcuggaaaaaccacuauuuuauauaaacuuaaauuaggagaaauuguaaccacaaucccaacuauuggauuuaauguugaaacuguugaauauaagaacauaaguuucacagucugggauguugguggucaagacaaaauucgacccuuguggcggcauuauuuucaaaauacucaggggcucauuuuuguuguagacaguaaugauagggaacguauuggugaagcgcgagaagaacugaugagaaugcuggcagaagaugaauuaagggaugcaguucuucuuauuuuugcaaauaagcaggaucugccaaaugccaugaaugcagcugagauaacagacaaacucggccuacacucauugcgcaaucgcaacugguacauucaagcgacgugugcgaccucaggcgauggucuauaug

SEQ ID NO: 256 - RNA, 307 nt, Nevara viridula
auccuaaagccuacccauuggcugaugcuacccucacugcuaagauauuaaauguugugcagcaagcucugaacuacaagcaguuaaggaaaggugccaaugaaucuacuaaaacuuugaaucgaggauuagcagaguuuauagugauggcugcugaugcagaaccacuagaaauauuauugcauuuaccucuauuaugugaagacaaaaaugugccauauguuuuuguccguuccaagcaagcucuuggaagagcgugcggaguuucucgaccuguugucgcuuguucagugacugucaaugaagg

SEQ ID NO: 257 - RNA, 768 nt, Nevara viridula
acuuagcugauucaguugcaccuacugauauugaagaagggaugagagucgguguugauagaaacaaauaucaaauucagauaccucuuccaccaaaaauagauccaacuguaacuaugaugcagguugaggaaaaacccgaugucacuuacagcgauguuggugguugcaaugaacaaauugaaaaauugagagaaguaguugagacaccuuuguuacagccugaaaaguuugugaauuuaggaauugaaccaccaaaaggaguucuucuuuuugguccuccugguacaggaaaaacacuuugcgcuagagcaguugcuaauagaaccgaugcuuguuuuauaagaguaauugguucagaacuuguccaaaaauauguuggagagggagcaagaauggugcgugagcucuuugaaauggcuagaaguaaaaaagcuugccuaauuuuuuuugaugaaauagaugcuauugguggagccagguuugaugacggagcugggggugauaaugaaguucaaagaacaauguuagaacuuaucaaccagcuugaugguuuugaucccagggguaacauuaagguuuuaauggcaacaaauagaccugacacuuuggacccugccuugaugagaccuggaaggcuggacagaaaaguagaguuuggacuaccugaucuggaaggucguucucauauuuucaaaauucaugcacgcucaaugaguguagagagagauauucgauuugaguuacuugcuagacucugucccaaua

SEQ ID NO: 258 - RNA, 383 nt, Nevara viridula
auuucacagcaccaucucauauuagaaggaaauugaugucuucuccucucuccaaagaacuuaggcagaaauacaauguccgcaccaugccuguuaggaaagaugaugaaguucaaguuguuagaggacauuauaaaggacagcagguaggcaaaguuauucagguauacagaaagaaguuuguuauuuauaucgagagaauucaaagagagaaagccaauggugccaguguguauguuggcauccacccuuccaaaacggucauuguuaaacuaaaaauugacaaagacaggaaagaaauuuuggauagaagauccagaggaagagcucuagcccuuggaaaagacaaaggaaaguacaccgaugagaacacagcaauggau

SEQ ID NO: 259 - RNA, 715 nt, Nevara viridula
gcugcuggaacuuuaaucacacuuucgaaugcuccuacugcaauaaaagcugcugcuucuuguuacauugauuugauaauaaaggaaagugauaauaauguuaaauuaauuguauuagaucgucuuauaucuuuaaaagaaauuccuacucaugaacggguucuucaagauuuaguuauggauauauuacgugugcuagccaguccugacauggaaguaaagaaaaaagccuuaagccuagcacuggaucucacuacuucacgguguguugaagaaaugguuuuaauguuaaaaaaagaaguugcuaagacacauaacuugacagaacaugaagaugcuggaaaauaucgucaacuucuuguuagaacucuucauuccuguugcaugaaguuuccagauguugcugcuucaguuauaccaguauuaauggaauuucucucagauacaagugaacuagcuucguaugauguucuuauauuuguccgagaagcaauucauaaguuugauucuuuaaggguuuugaucauagagaaauuauuagaagcguuuccaaccauaaaaucuaugaaaguucaucgagcugcucuuuggauauugggugaauauacuacuucaguuacagauauuaaagaagucaugaaacaaauaaaacaugcccuuggagagauaccacuugucgaugaugaaauaaaaagagcuucuggagagaaaguug

SEQ ID NO: 260 - RNA, 399 nt, Nevara viridula
ccuuacaaaggcaaguugugugcuauuguggaugucauuaaccagaccagggcuuuaguugaugguccugaaacuggaguaccaagaugugguauaagauuaaaucaauuacaucuuacaaaauuuagaauucguuucccauauacugguucaacacguguuguacgaaaagcuuggaaagauagcaacuuagaugcuaaguggaaggaaaguguuugggccaaaaaguuagaagcaaaaaaaauaagagccaauaugaaugacuuugacagguuucgccuuaauaaugcuaggagaaccaggagcaaaaucaccaccaaugcauuuuugauucugaagaaacaagcuaaaaaggcuaaaaaaaccgaaguaaaaucuaaagacaagaaaccagaagcu

SEQ ID NO: 261 - RNA, 714 nt, Nevara viridula
aaggcccauuacaaacuaggcuucuugaaaugaauuuaauuucugcuccucagguugcugaugcuauacuugggaaccaaauguuuacacacuaugauagagcccauauugcucagcuuugugagaaggcuggucuacuccaaagagcauuagaacauuauacagaucuuuaugauauaaaacgagcuguuguucacacucaucuucuuggcccugauuggcucguggguuauuuugguacccuuuccguugaagauucucuugagugucugaaagccauguuaacagcaaauauucgacagaauuuaaauauauguguucagauugcaacuaaguaccaugaacagcugacaaccaaggcuuugauagaucuuuuugaaucauucaaaaguuaugagggauuguuuuauuuccugggcucaauaguuaauuucagucaagaucaagaaguucauuuuaaauacauucaggcagcauguaaaacaggacaaauaaaagaaguugaacgaauuugccgugaaucuaauugcuauaauccagagagaguaaaaaauuuuuugaaggaagcaaaauugacagaucaauuaccacuuauuauuguuugugaucgauuugauuuuugucaugauuugguuuuauauuuauacagaaauaauuugcaaaaguauauugaaauuuauguacaaaaggucaauccuucucguuuaccuguug

SEQ ID NO: 262 - RNA, 454 nt, Nevara viridula
agaucuucgugaaaacccucacggguaagacaauuacccuugagguugagccuucugauacuaucgaaaaugucaaagcuaaaauucaagauaaggaaggcauuccuccugaccagcagcguuugauuuuugcuggcaaacaguuagaagauggccguacucuuucugauuacaacauacaaaaggaaucuaccuugcacuuagugcuuaggcuuaggggaggugccaagaagcguaagaagaagaauuacuccacuccaaaaaaaaucaagcacaagaagaagaagguuaaacuagcugugcuuaaauauuauaagguugacgagaaugguaaaaucagcagguugaggagggaaugccccuccgagcagugcggugcuggcgucuucauggcugccauggaggacaggcacuacuguggaaagugugccuacacccuugucuucaauaagcc

SEQ ID NO: 263 - RNA, 497 nt, Nevara viridula
aggaauugaggauaaucggcgaguauggacugagaaauaaacgugaaguauggagggucaaauauacucuugcuaaaaucaggaaagcugccagagaauugcuuacucuugaugagaaggaucccaagagguuguuugaaggaaaugcacuuuugcgaagauuaguaaggauaggaguauuagaugaggcuaaaaugaaacuugauuauguuuugggucucaaaguugaagauuucuuggaaagaagacuucagacacagguuuuuaaacugggucuugcuaagucaauucaccaugcuagaguuuugauaagacaaaggcauauaagagugaggaagcagguugucaauauacccagcuucauugugagguuagacucacaaaaacacauugacuucucauugaaaucaccauucggugguggccgcccuggucguguaaagaggaagaauucucguaagggaacuacugcugcugcugcagaggaagaugaagau

SEQ ID NO: 264 - RNA, 716 nt, Nevara viridula
acccuauugcaacaaggauuuaaaccuccuacugcccagaagacugguacaacuauuguuggaaucguauacagagaugguguuauccuuggagccgauacgagagcaacagaagguagcacaguugcugauaagaauugcuccaaaauacauuuccuugcugacaacaucuauugcuguggugcugguacugcugccgacacugaaaugaccacuaugacaauaaugucacaauuggaauuacaucgccuuaauacugggcgcccagucagaguuucuacugccaagcagcuuuugaaacaacuucucuucagguaucaggggcacauuggagcagcucuuguaguuggugguguugacguaaccggaccucuucuuuauucuauacauccucauggcuccucugagugcuuaccguuuacaacuaugggcucgggaucucuugcugcuaugacgguacucgaaucaucauggaagcccgauuugacggaagaagaagguaaaguaauuguccguaaugccauugcugcugguauauucaaugaccuugguucuggaagcaacguggacguuugcaucauccgcaaagguucuguugauuauauucgccccuuugauaucgcuaaucuaaaaggacagaagcaaaauaauuaucgcuuccgucgaggcacuacaggaguucuuucaacuagaauaaucccuuuggugacagaauc

SEQ ID NO: 265 - RNA, 631 nt, Nevara viridula
aaauugaguaugcacuugccgcagucgcagcuggagcuccaucaaucgguaucagagcauccaauggaguuguauuggcuacugaaaacaaauacaaaucaauuuuauaugaagaacauacuauucaaaaaguagaaaugauaacuaaacacauuggaauggucuacaguggaaugggaccugauuauaggcuacuagugaagagagcuagaaaaauggcucaacaauaucaguuaguuuacggugagccuauuccuacugcacagcuuguucaacgaguugccaugguuaugcaggaguacacucaaucuggagguguuagaccuuuuggaguuucuuuacucauugccgggugggauggggauaaaccaucucuguuucaaugugauccaucuggagcauacuuugccuggaaagcuacugcaaugggaaaaaauuuugucacuggcaaaacauuucuagaaaagagguacagugaaacuuuagagcuggaugaugcaguacauacugcaauucucacucuuaaagaaaacuuugaaggccaaaugacuucggacaauaucgaggucggaguuugugaugaucaaggguucagaguuuuagauccuacaacagugaaggauuaucuggc

SEQ ID NO: 266 - RNA, 701 nt, Nevara viridula
ccacuucugcuaaaccaucagccaaacaacccgcuccagcuccuaaagccgcucagcccaaagcccaggcgaagccugccgcucaacaacaaaagccugcuaaaccacagcagcaaacaaaaacugcagcuccggcuaaaggucaagcuaagccugcagcccaggcaaagcccgcugcuccagcugcagcuccuaaacaacccgcagcuccagcugcagcaggaacucaaccugccgcagcagcacccaagaaagcuccuucaggugcaguuaaaaaagcaacaacugcgcccaaaaaaagucaaaauuuacagaagaagucccaccaagguguuaggaaacaaguguuaaaaggaaaaggacagaaaaagaaaaaaguaucauuaaaguuuauaauugacuguacucauccauaugaagacaaaauuauggacgucgccaacuucgaaaaguauauucaagaaagguuuaaaguuaaugguaaaaccaacaacuuaggcaauaauguuacuuuggaaaggaacaagaugaaaauaacuguuacuucagauguucauuucccuaagagguacuugaaauauuugacuaagagguaccuuaagaagaacaauuugagggauuggcucaggguuguaucuaguucgaaggauaccuaugaacuaagguacuuccaguuuaauagccaggaugaugaugaugaa

SEQ ID NO: 267 - RNA, 252 nt, Nevara viridula
uggaggaagauccaaacaugguaggggucacgugcaagcaguccguugcaccaacugugcccguugcgugccaaaagauaaggcuaucaagaaauucguuauucguaauaucguagaagcugcagcugugagggauaucacagaugcuagcguuuacucuucguaccaguugccgaagcucuaugccaaacuacauuauugugugucaugugcuauccacucuaaaguagugcguaaucguucuaaggcuga

SEQ ID NO: 268 - RNA, 779 nt, Nevara viridula
gaggcgacaacuagguaaaacugacuauuaugccaggaaaagguugauuguucaagauaaaaauaaguacaauacaccaaaauaucguuuaaucguccguuuuuccaacaaagacaucacuugucagguugcuuauucacgcauugaaggugacaaaauauugugugcugcauacagccaugaacuuccucauuuuggaauuaaaguaggauuaacuaacuaugcugcugccuacugcacuggucuucuuuuggcuaggagguuacuucagaaauugaaguuggaugcacuauaugaagguacaacugaaguaacuggugaugaauacaauguagagaacuuggaugaaggcccaggagcuuuccguuguuauuuggauguugguuuaaugaagaccagugcuggagcccgaguuuuuggggcauugaaaggugcuguugauggaggucucaacaucccucacagcaugaaaagauuuccugguuaugauucugaaaguaaggaguucaaugcugaaguucaccgaaaacauauuuuuggaauucacguugcugauuacaugaggcaguuggccgaaucugaugaagaugcuuacaagaaacaguucagcauuuacaucaaaaaugggauuguuccugaugcuauugaagacauuuauaagaaggcacaugcagcaaucagagaaaauccugcucauagaccacaaguaaggacuaaggaagccaucaagaagagauggaaucgugcuaaacuuacccuugccgaaaggaagaauugua

SEQ ID NO: 269 - RNA, 512 nt, Nevara viridula
gacuuuaacagggaagaccaucaccuuagaaguugaaccaucugauacuauugagaacguaaaagcaaaaauccaggacaaagaaggaauuccaccagaccagcaacguuugaucuuugcuggaaaacaacuugaagauggccguacccuuucagauuauaauauucaaaaagagucuacucuucaucuuguacuucgcuugagagguggcaugcagauuuuuguuaagacgcuuacuggaaaaaccauaacuuuagaaguugaaccgucagauaccauugaaaauguaaaagccaaaauucaagauaaagaaggaauaccaccagaccaacagaggcuuauuuuugcuggaaagcagcuggaagauggccgaacuuugucugauuacaacauucaaaaggaaucaacacugcauuuggugcuucgucuaagaggaggcaugcagaucuuugugaagacuuugacagguaaaaccauuaccuuggaaguagagccaucugauacaauugaga

SEQ ID NO: 270 - RNA, 467 nt, Nevara viridula
ugaggcgaagaaagcuaaacaggccgagaucgagcggaagagagcagagguccgaaagaggauggaggaggccucaagaggcaagaaggccaagaaagguuucaugacgccagacaggaagaagaaacuccgacuucugcugaggaagaaagcugcugaggaacugaaaaaagaacaagaaaggaaagcagcugagagaaggaggaucauugaggagcgcuguggaaagauaugugauguugacaaugccaaugaagagacccugaagaaaaucugccaagacuaucacaagcggauugaugcuuuggaacgcaguaaaauugacaucgaguuugaaguggagaggagggauuuugagauugcggaucuuaacagccaagucaaugaucuucguggaaaauucguaaagcccaccuuaaaaaagguuuccaaauacgaaaauaaauuugccaaacuucagaagaagg

SEQ ID NO: 271 - RNA, 354 nt, Nevara viridula
auggcgcccaaggcuccuaaauaugaaauggcuguuggucuuaaaaaaggucacaggacaaccaagauuguaaugggaaaguccaaagcugauaagaagcacaaaauuagaccaucacgccugaaagguagacaaaccaagcauacaaaguuuguuagagauuugaucagagaaguaugcggucaugcaccuuaugaaaagagaggaauggaguugcucaagauuuccaaggauaagagggcuuugaaauuuuugaagagaaggaucggcacucacauccgugcuaagaggaagagggaagaacuuagcaacauucuuacucagaugcguaaggcacaugcccaacaaaaauaa

SEQ ID NO: 272 - RNA, 681 nt, Nevara viridula
augucucuuagcgacgcagauguacaaaaacaaaucaagcacaugauggccuucauugagcaggaggccaaugaaaaggcugaagaaauugaucaaaaagcugaagaagaauucaauauugagaaaggaaggcuuguucagaaucaaagauuaaagaucauggaauauuaugaaagaaaagaaaaacagguggaacuucaaaagaaaauccaaucuucaaauauguugaaucaagcucgacucaaagcuuugaaaauacgugaagaucauguucgcgauguacucgaugaggccaggaagagacuguugcaaucagucaaagacgaagcacguuacaaagauauccuugagaaacucaugcuucagggguuguaccaguugauggaaucagacauuuugguuagaacucgugaaauggauggcccaguugugagcucaguguucccugaugugcuggugaaauacaaggaaucaucagguaaggauuugcagcugaaguuggauacagaauuguacuuaccaucugaaugugcugguggcauugaacuuuacacugcgagaggccguaucaagauuguuaacacucuugaauccaggcuugaucuuauuucagcacaauuguugccucaaauuagaacauccuuauucggucguaaugugaaccguaaauucacugacuaa

SEQ ID NO: 273 - RNA, 357 nt, Nevara viridula
auggccagucagacucaagggauucagcaauuauuagcggcugagaaaagagcugcugaaaaaguugcugaggcgaaaaaacgcaaggcuaggcgucuaaagcaagccaaagaagaggcccaagaagaaauugaaagauacaagcaagacagagagaaacaguucagggaguuugaagcucagcauaugggcucacgagaagauguugcagcaaggauagaugcugauacacgccaaaagauugaagaaaugaaugaagcaguuaaugcuaacaaagaagcaguuauucaaagaauuuuggaauugguuuacgauaucagaccagagaugcauaagaacuacagagcaccaaacuaa

SEQ ID NO: 274 - RNA, 1293 nt, Nevara viridula
augucuacuucuaaaacagaagaaaagcccaugugggacgaaaggauggaacaagcuuuaagugaagaaauaaugagaaugucuacugaugaaauuguaagccgcauuagacuucuugauaaugaaauuaaaauaaugaaaagugaaguaaugcgggucagucaugagcugcaagcacaaacagaaaaaauaaaggaaaauacagagaagauuaaaguaaacaaaacuuuaccauacuugguaucaaaugugauugaguugcuugauguagauccagaggaaacugaggaagauggugcuguuguagaucuugacgcucgucgaaaaggaaaaugugccguuauuaaaacaucaaccagacaaacuuauuuuuugccuguuauuggcuuaguugaugcagaaaaauuaaagccaggugaccuuguuggugugaauaaagauucuuauuugauucuugaaacuuuaccugcagaauaugaugcacguguuaaagcuauggaaguugacgaaagaccaacugagcaguauucagacauuggugggcuagacaaacagauucaagagcuaauugaagcuguuguucuucccaugacccacaaagaaaaauuugaaaaucuuggaauucauccuccuaaagguguauuacuuuauggaccuccuggaacaggaaaaacuuuauuggcaagagcgugugcagcucaaacaaaaucuacuuuucugaaacuugcugguccccagcuaguacagauguucauuggggauggagccaaacuuguuagagaugcuuuugcucuugcuaaagaaaaaucuccagcuauuauauuuauugaugaguuggaugcuauugggacaaaaagauuugauucugaaaaggcuggugaucgagaaguucaaagaacuauguuagaguuacucaaccaguuagauggauuuaguucaacagcugacauaaagguuauugcugcuacaaauagaguagauauuuuggauccugcccuuuugcguucuggacgacucgauaggaaaauugaauucccacauccuaaugaagaugcuagagcacguauaaugcaaauacauucccguaaaaugaauauuaguguagaugugaauuuugaagaacuugcucguucaaccgaugauuucaauggagcucaguguaaagcuguuuguguggaggcugguaugauagcuuugcgucgaggagcuggaguaguuacccaugaagauuucauggaugcaauauuggaaguacaagcaaagaagaaagccaacuuaaacuauuaugcuuaa

SEQ ID NO: 275 - RNA, 387 nt, Nevara viridula
augcagaucuucguuaagacccucacggguaaaaccauuacccuagagguugaaccuucugauacuauugaaaaugugaaagcuaagauucaagacaaagagggaauuccuccagaucagcagaggcuuauuuuugcugguaaacaauuggaagauggaagaacuuugucugauuacaacauucaaaaagaaucuacucuucauuugguccuucgucugagggguggugucauugaaccaacucucaaaauucuugcacagaaauacaauugugacaagaugauuugccgcaagugcuacgcuaggcuucacccgagggcaacuaacugccgcaagaagaaaugugggcauaccaacaauauccgccccaagaagaagcugaaguag

SEQ ID NO: 276 - RNA, 1188 nt, Nevara viridula
augacggcuucucaagcaauggaaccaaacagagaaaaggcuuuacaagauuaucguaaaaaauuacuggagcauaaagaaguugaagucagacuuaaagaaaugagagaccaguuaaaagaucuuaccaaacaauaugauaaaucugaaaaugacuugaaagcccuucaaaguguuggucagauuguuggagaaguauuaaagcagcuuacugaagaaaaauuuauugucaaggcuaccaaugguccaagauauguuguugguuguagaagacaacuugauaaauuaaaacuuaaaucuggcacgaggguagcauuggacaugacaacuuuaacaauuaugcgacauuugccgagagaaguugauccauuaguguauaacaugucucaugaagauccaggagauguaacauauucugcuauuggaggucuugcagaacaaauuagagaacuucgugaggugauugagcugccucuguugaauccugaacuuuuucaacgaguugguauuacuccaccuaaaggaugucuacuuuacggcccuccugguacuggaaagacuuuguuggccagagcuguagccagccaauuagaugcaaacuuccuuaagguagucuccagugcuaucguugacaaauauauuggagaaagugcucgucuaauuagagaaauguuuaauuaugcaagagaucaccagccuugcauaauuuuuauggaugaaauugaugcuaucggaggucgacgauucucagaaggaacaucugcugaucgugaaauacaaagaacucuuauggaacuucuuaaccaaauggauggauuugauucucugggacagguuaaaaugaucauggccacuaaucgucccgauaccuuagacccugcucuucuccguccuggcaggcuagacaggaagauugaaauuccuuugccaaaugaacaggcaaggcuagaaauccucaagauccaugcugggccuauuucuaagcauggagauauugauuaugaggcugucgugaaguugucugauaauuucaauggagcugacuugagaaauguuuguacugaagcuggccuuuuugcuauucgagcugaaagagaauauguaaugcaggaagacuuuaugaaagcugugagaaaaguggcugacaauaagaaacuugagucaaaacucgauuacaaaccaguauaa

SEQ ID NO: 277 - RNA, 1251 nt, Nevara viridula
auggcgggugcaauguuguuugagaggacugucucuuccagagauagggauaauagucgaauucuuccaacuucuagcagaaacguugacgaagaaaaugaagaagacaucaaaaauaaggaacaaggaauuuugcaguugggagagcaauauaagaaagaaggcaaagcuaaagaguuagcagagcuuaucaaggcaaguagaccauuucuuagccagauuaguaaagcuaaagcugcaaaauuagugcguucuuugguagauuauuucuuggaucuugaagcuggaauaggaauagaaguucaacuuuguaaagaguguaucgaaugggcuaaagaugaacacaggacuuuucucaggcagucacuggaagcuaggcuuaucgcucuauauuucgacacaggaauguuuacagaagcacuacagcuuggcucaagucuucuuaaagaauuaaagaaauuagaugauaaaaauuugcuuguugaaguccuuuuguuggaaucuaaaacuuaucaugcuuugagcaaccuuucaaaagccagggcugcuuugacaucagccaggacaacugcuaauuccauauauuguccacccaaaaugcaagcagcccucgauuugcaaucugguauauuacacgcagcagaugaacaagauuucaaaacagcuuacucauauuucuaugaagcuuuugaaggcuaugauaguguagagagcccaaaggcuuuaguugcucuuaaauauaugcuucugaguaaaaucauguuaaacacaccagaagacgugcagcaguugguuagcgggaaacuugcucuuaaacaugcugguaaagauauugaugcaaugaaaucaguugcucaagccagccauaagagaucacuugcugauuuccagcuaacuuuaaaaaauuacaagaaagagcuugaggaagauccaauuguacgagcucacuuggguacacucuaugauaauauguuggaacaaaauuuguguaggaucauugagccuuauuccagagcucaagucgauuuuauuucaaaaucaauuaaacuuccccuuccucaaguugaaaagaagcuuucucaaaugauucuugauaagaaguucaaugguauucuugaccaaggugagggaguucuuauaguguucgaagaugcgauuguugaaaaaaccuacgaaauggcccuggaaguuauuaacagcauggguaagguuguagacacauuauaucaaaaagcuaagaagcucucuuaa

SEQ ID NO: 278 - RNA, 480 nt, Nevara viridula
augacaaacuccaaggguuaucgccgagguacccgugauuuguuuucacgugguuacaggaaacauggugucaucccacuuucgacguacaugaaaguauacaaaguuggagauauuguaucgauuaagggaaauggugcuguucaaaaggguaugccccacaaaaguuaucaugggaaaacaggacgaguuuacaauguaacuccuagagcuuugggugugaucgucaacaaaaggguccguggaaaaauucuaccuaagaggauuaacauccguauugaacaugucaaccacuccaagugccgugaagauuucuugaagcguguacgagaaaaugagaggcucaggaaagaggccaaagaaaagggcauucauguugaauugagaagacagccugcccagccacgaccugcucauuugauaacugucaaagagccuccaauaaugcucgcuccuauaccuuaugaauuuauugcuuaa

SEQ ID NO: 279 - RNA, 657 nt, Nevara viridula
gaaguuccacacuggucuccauguuguuuucuuucaguguggaacuucgggauuaccaugaguucguugaaguuacagaagaggcuagcagccucuguuaugagaugugguaaaaaaaagguuugguuagacccaaaugaaauuaaugaaauagccaauacaaauucaagacaaaacaucaggaaguuaaucaaagaugguuuuauuaucaagaaacccguugcaguacauuccagggcccguguucguaaaaauacugaagccagaaggaaagguaggcauugugguuucgguacaaggaaagguacugcuaaugcaagaaugccagcgaagguguugugggugaacagaaugaggguucuuaggcgguuacugaagaaguauagagaagccaagaaaauugauaggcagauguaucaugacuuauacaugaaagcaaaagguaauguuuuuaaaaacaagcguguauugauggaauuuauucauaagaagaaagcugaaaaagcuagguccaaaaugcuccgugaucaagcugaagccaggaggcaaaaaguuaaagaagcaaagaagcggcgagaagaaaggaucacaaugaagaaacaagaaauauuacaaucuuaccagagggaagaugaagcugcaucagcuaaaaaauaa

SEQ ID NO: 280 - RNA, 690 nt, Nevara viridula
auacagucggccuugagggaguaucgaggaagcucuucguucacguuaccguguuucuacaagccuucauucgcaaugggggcuuacaaguacauccaggaauuguacagaaaaaagcagucagaugccaugagguaucugcugcgaaucaggguuuggcaauacagacagaugaccaagaugcaccguguugugaagccuucaagacccgauaaagcuaggagauugggauuuaagaauaaacaagguuucuguguauucaggauccguaucaagcgaggaggcaggaaacgcccaguuccaaagggugcuaccuauggcaaaccuaaaagccauggaguaaaccaguugaaaccuacaagaagucuccaugcuauggcugaggaaaaaguugguaggaagugcaguggauugagaguauuaaacucuuauuggguagcccaagacgccagauacaaauacuacgaagucaucugcguugacccagcucacaaggcaaucagaagagaugcuaaagccaacuggauaugugacccagugcacaagcaccgugagaugcgugguaagacuagcgcugcuaggaagucacgaggucuuggcaagggccacagauacucacagaccaagggagguuccaggaaggccgccugggugagaaggaacaccuuacagcugcgcagaaagcgauaa

SEQ ID NO: 281 - RNA, 1131 nt, Nevara viridula
augugugacgaagaaguugcugcuuuaguuguagacaauggauccgguaugugcaaagccgguuuugcuggagaugaugcaccccgagcaguauucccaucaauuguuggcaggccaaggcaucagggugucaugguugguaugggccaaaaggacagcuauguuggagacgaagcccagagcaagagagguaucuuaaccuuaaaauacccaauugaacacgguauuguaacuaacugggaugauauggaaaaaauuuggcaucacacuuucuacaaugaacuucgaguugcgccagaagagcacccaguucuccugacugaagcaccuuugaaccccaaagcaaauagggaaaaaaugacacagaucauguuugaaacauucaacacuccagcuauguauguugccauucaagcuguucugucccuguaugcaucuggacguaccaccgguauuguucuggauucuggagauggugucucacacacuguaccaauuuaugaagguuaugcucuaccucaugccauccuuagguuggauuuagcuggacgugaccucacugauuaccucaugaagauccugacugaaaggggauacuccuucacgacuacugcugagagagaaauugugagggauaucaaggaaaaauuguguuauguugcucuugacuuugagcaggaaauggccacugcugccaguucaaguucccuagaaaaaucuuaugaacuuccugauggacaaguuaucacaauuggaaaugaaagguuccgaugcccugaagcucuguuccagccuucuuucuuggguauggaggcaugugguauccaugagaccacuuacaacucaaucaugaaaugugaugucgacauuaggaaggacuuguaugccaauacuguucucucuggagguacuaccauguacccugguauugcugauaggaugcaaaaggaaaucacugcccuugcuccuucuacaaugaaaauuaagaucauugcuccaccagaaaggaaguacucaguauggaucgguggaucaauccuugccucccuuucuaccuuccagcaaauguggauuucuaagcaggaauaugacgaaucuggcccaucuauuguucacaggaaauguuucuaa

SEQ ID NO: 282 - RNA, 1131 nt, Nevara viridula
augugugacgacgauguugcugcccucguaguugacaaugguuccgggaugugcaaggccgguuucgccggagacgacgccccgagggccgucuucccauccaucgucggaagacccaggcaccagggugucaugguugguaugggccaaaaggacagcuacguaggagaugaagcccaaagcaaaagagguauccucacccugaaguaccccauugaacacgguaucaucacaaacugggacgacauggaaaagaucuggcaucacaccuucuacaacgagcugcgagucgcuccagaggaacaccccauccuccucaccgaggcuccccucaacccuaaagccaacagggagaagaugacccagaucauguuugagaccuucaacaccccagccauguaugucgccauccaggcuguacucucccucuaugccuccggucguaccaccgguauuguacuugacucaggagaugguguaucccacaccguacccaucuaugaagguuaugcccuuccucacgccauccuccgucuggaucuugcuggacgugacuugacugacuaccuuaugaagauccucaccgaacgugguuacaguuucacaaccaccgcugaaagggaaaucgucagggacaucaaggaaaaacugugcuauguugcccuggacuuugaacaggaaauggccaccgcugcugccuccaccucccucgagaagucuuaugaacuuccugacggucaggucaucaccaucgguaacgagagguuccguugcccagaggcucucuuccagccuuccuucuuggguauggaaucuugcgguauccaugagacugucuacaacuccaucaugaagugcgauguugacaucaggaaggacuuguacgccaacaccguccucuccggagguaccaccauguacccagguauugcugacaggaugcagaaggaaaucaccgcccucgcuccuucaaccaucaagaucaagaucaucgcucccccagaaaggaaguacuccguauggaucggugguuccaucuuggcuucccuguccaccuuccagcagauguggaucuccaagcaggaauacgacgaauccggcccaggcaucguccaccgcaaaugcuucuaa

SEQ ID NO: 283 - RNA, 1518 nt, Nevara viridula
auggugcuaaucgcagcagcgguuugcacaaaagcugguaaaaccauuguuucaaggcaguuuguugaaaugacuaaggcccgcauugaaggauugcuagcagcauuuccaaaauugaugucaucggguaaacagcauacauuuguugaaacugauucagugcgauauguguaucagccgcuugagaaacuuuacauggugcugauuacuacuaaggccucaaauauuuuagaagaucuugaaacauuaagacuauuuucucgugugaucccugaguauugccgcaauauggaagagucagaaauuacugaaaaugcauuuaaucugauuuucgcauuugaugaaauuguggcucuugguuacagggaaaguguuaacuuagcucagauuaggacuuauguugaaauggauucucaugaagagaaaguauacauggcuguaagacagucucaagagagagaagcuaaaaauaaaaugagggaaaaggccaaagagcugcagagacaaagguuagaagcuggaaagaaaggcuacaaaacaccaaguauugcuggauuugguucaucaucaacguacacuagcccuguugucgaaacuauugaucugccuaaaccuacauacacaccugcgaaaccugucuuaacagcgaaagcuaugaaacuaggugguaaaucuagagaugucgaaucauuuguugaucaacuaaaaucagagggagaaaaugugauuucacaaguggcugcgaauaaaccuguugcagcuaaguuagccucuacaccaaauauucauauggaagagguccaucuaaaacaggaagaaaaacuaaugguuucuguaggaaaggaugguggaauacaaagcuuugagcuccaugguuugguaacauuacggauaacugaugaaaaauaugcuaagauaaaaguauaucucgauaacaaagauaagagaggaauucaguugcagacgcauccgaacguggauaaagaauuauucaaaaugaagucgcagauugguuugaagaauccuucaaaaccauuuccuuuaggaacugauguagguguacuuaaauggcgauaccaaucucaagaugaaucugcacuuccucuaaccauaaacugcuggccaucugaaaauggacaaggaggaugugaugucaauauugaguaugagcucgaacauucucaccuugaacuaaaugauguuaccaucaacauuccauuaccuauugggugcucuccuguuguugcugagugugauggcgaguacaaacacgagucccgaaggaacuugcugcaauggguacugccaguuauugacaggaguaacaaaucaggagcgauggaguuuucgacaucuucugcuauuccuucagacuuuuucccuuuaacaguaucuuucaccuguaaacagccuuaugcagaucuaaaggcuguugagguucuucauguugaugaugaaacuccuguaaaguuuucaagugaaacauuguuuuauacagaaagguaugaaauuguauaa

SEQ ID NO: 284 - RNA, 1269 nt, Nevara viridula
augucgguaacgucgucugacaaaaggaaugaggauuggguaggagagucuaaaaaugggccaagcgacaaagaacauucuuaugaugguccacccgguauggacccugaaggaaucaucgaguccaacugggacgaggugguggacaauuuugaugauaugaaccuuaaagaagaacuucugagagguauuuaugcuuaugguuuugaaaaaccuucugcuauacaacaacgggcaauuaucccuuguguuaggggucaugauguuauugcccaagcucagucagguacugguaaaacagcuacauuuuccauuucaauauuacaacaaauugacacuagugcaagagaaugccaggccuugauuuuggccccaacucgugaauuggcccaacagauccagaaaguagucauagcccugggagauuuuaugggggccaugugccaugcaugcauuggugguacaaauguuagagaagacaugcgcaaacuagaaauggguguucauguuuugguuggaacucccggacgaguuuuggauaugauuagccgcagagcucuaaaaacuaacaccauuagaauuuuuguguuggaugaagcugaugagaugcuuucucgugguuucaaagaucagauccaugauguauuuaaaaauuuaaaucaugaaguacagguuauauugcuuucagcuacuaugccaucagauguauuggaggucaguacaugcuucaugaggaauccuauucguaucuuaguuaaaaaagaagaacuuaccuuggaagguaucaaacaguuuuuuguuuuuguugagagagaagaguggaaguuggauacucucugugauuuguaugaaacacuaaguauuacucaagcuguaauuuuuuguaauacaaggcgcaagguugauugguugacugagaguaugcauaauagagacuucacuguuucugcuaugcacggugauauggaacaaagagaacgagauauuauuaugagacaauuccguacugguuccaguagaguuuuaaucacuacagaccuuuuggcaagaggcauugaugugcaacaaguuucucuugucauaaauuaugaucuuccaucuaauagagagaauuauauucacaggauuggaagagguggccgauuuggucguaaagguguggcgauuaauuuuguuacagaagaggacaaacgcucucuuaaugauauugaacaguucuacaacacccguauugaagaaaugccuaugaauguugccgaccucauuuaa

SEQ ID NO: 285 - RNA, 792 nt, Nevara viridula
auggcucguggucccaaaaagcauuugaagcguuuaaaugcuccaaaaucauggauguuggacaagcuuggugguguuuuugcgccaaggcccagcucagguccacacaaacuuagggaaucauugcccuuaguaauuuuucuccguaauagacuaaaguaugcacuuacaaauacugaaguaacuaaaaucgugaugcagcgucucauaaaaauugauggcaaagugaggacagacccuaacuacccugcagguuucauggaugugauuagcauugagaaaacuggugaauuuuuccgauugaucuaugauguuaaggggcguuaugcuauucacagaauuacugcugaugaagccaaguacaagcugugcaagguuaaaagggugcagacugggccuaaggguauuccuuacuuaguuacccacgacgcuagaaccaucagguacccagauccacucgugaaaguucaugauaccauucagcuugauauugcuacuggcaaaaucaucgauaucauccgaauggagucagguaaccuuugcaugauuacuggaggucguaacuugggaagaguugguacuguuguaaacagggagagacauccuggauccuucgauaucguucauaucaaggaugccaguggccacaccuuugccacacgguugaacaauguguucaucauugguaaggguagcaaagcuuacguuucauuaccuaaaggcaagggugugaaauugaguaucgcugaggagagggauaagaggcuugcggcgaagggugcauccagcuaa

SEQ ID NO: 286 - RNA, 2409 nt, Nevara viridula
auggcugauaugaaaaguaaugaagauuuguccacugcuauccugaaaaagaaagaucggccgaauagauugauuguugaagaugcagucaacgaugauaauucaguuguugcucuuucacaggcuaagauggaugaacuucaauuauuucguggagacacugugcagcuuaaagggaaaagaaggaaagaaaccguuuguauuguguuaucugaugauaccugcccugaugaaaaaauuaggaugaacagaguuguuagaaauaaucuacgaguucguuugucagauauuguuucaauucaagcuuguccugaaguaaaguauggaaaaagaauucauguuuuaccaauagaugauacuguugagggauuaacagggaaccuuuuugaagucuuucuuaaaccauacuuucuggaagcauaucguccuauucauaaagaugauacauuuguugucagaggugguaugcgugcuguugaauuuaaaguaguagaaacggauccugcuccuuauuguauuguagcaccugacaccauuauucauugugagggcacucauaucaagagagaggaagaagaagaagcuuuaaaugcuguuggauaugaugauauuggagguuguagaaaacaacuugcucagauuaaagaaaugguugaacuuccuuugagacauccuagcuuauucaaagccauuggugucaaaccuccucguggaauauuacuuuauggaccaccuggaacugguaaaacauugauagcacgugcuguggccaaugaaacaggagcauuuuucuuuuuaaucaaugguccagaaauuaugaguaaacuagcaggugaaucggaaaguaaccugcguaaagcauuugaacaagcugaaaaacaugcaccuuccauaauuuuuauagaugaauuggaugcuauagcuccaaaacgagacaagacccauggagaaguagagcggagaaucgucucacaauugcuuacuuugauggauggucuuaaacaaaauucucauauaauuguuauggcugcuaccaacaggccuaauucaauugaugcugcucuuagacguuucggacgauuugaucgugagauugauauugguauuccagauacuacuggacguuuagaaguucuucgaauucacacaaaaaauaugaaacuugcugaugauguuaauuuagaacagauugcagccgaaacacauggucauguuggugcugauuuagcaucucucuguucagaagcagcucuucaacagauucgugaaaaaauggaucuaauugauuuagaagaagaccaaauugaugccgaaguucuuaauucucuugcuguuaccauggauaacuucagguaugcuaugggcaaaaguagcccuagugcccuucgugaaacagugguugaaguuccuaauauuacuugggaugauauugguggucucgauaauguuaaaaaagaguuacaagaauuaguucaguauccuguugaacauccagagaaguucuugaaguuuggaaugcaaccuucccgugguguuuuguuuuauggaccaccagguugugguaagacuuuguuggccaaagcuauugcuaaugaaugccaggccaacuucaucucgguuaaggguccugaauuauuaacuaugugguuuggagaauccgaagcuaauguccgugauauuuuugauaaggcuagagcugcugcaccauguguucuuuuuuucgaugaacuggauuccauugcuaaaucaagagguggaagugucggagaugcuggaggugcagcugauagaguuaucaaccaaauacucacagaaauggaugguaugggagccaagaaaaaugucuuuauaaucggagccacuaauagaccagacauaauugauccugccauacugagaccuggucguuuagaucagcucauuuauauaccuuuaccugaugagaagucaagagaagccauuuucagagcaaacuuaagaaagucaccuguugcuaaggauguugauuuacaauacauugccaaaguuacauuugguuauucuggagccgaucuuaccgagguaugucaaagagcuuguaaacuugccaucaggcagucaauugaagcggaaauuaaaagagaaaaaaguagauuagauggagcuacacgaauggauauggaugaugaagauccuguuccugaaauaacucgugaacauuuugaagaggcaaugagguuugcuaggcgaucagucacugauaaugauauucgcaaguaugaaauguuugcucagacauuacaacaaucaagagguuuuggaacuaauuuuagauucccugcuagcucaaauaucccuagcgcaccaggagguggaggaacagaaacuaacaacuuuccagaugauggagaugaugaccuuuauaauuaa

SEQ ID NO: 287 - RNA, 405 nt, Nevara viridula
augacuauugaagacgaaucgggcccaucuggcgacucaguggacauaaauaccgcucuuaaagaaguacuaaaaggaguugugagaaauggagucauaguacauggucugagggagucagcuaaagcucuugacaagcgacaggcauuacuguguguucuggccgaaaacugugaugagcccauguacaagaagcuugugcaagcucucugcucagaacaucaaauaccauuaguuaaggucgacuccaacaaaaaauuaggagaaugguccgguuuauguaaaaucgacaagacaggaaacccaaggaaaguuguugggugcucuuguguaguuauuaaggacuggggcgaugauacaccucaucuagauguacucaaagauuauaugacagaauccauguga

SEQ ID NO: 288 - RNA, 450 nt, Nevara viridula
aaaaaaaaaaaaaaaaaaaaauauguugugaacaguuauuauucgucaacgacagagaacacuuauagcagaaggaugucuggacguggcaaagguggcaaagccaagggaaaggcaaagacccgaucaucuagggcaggacuccaguuccccgucggucguauccaccgucuccucaggaaagguaacuacgccgagagggugggagcaggagcuccgguguaccucgcagcagucauggaauaccuggcugccgaaguucucgaguuggccggcaacgcagcucgugauaacaagaagacuaggaucaucccgcgucaucuccagcucgccauaaggaacgacgaggaguugaacaagcuguugucgggagucaccaucgcucaaggcggaguacuucccaacauccaggccguucugcugccgaagaagacagagaagagcucauaa

SEQ ID NO: 289 - RNA, 4605 nt, Nevara viridula
gccgucuuccguuccagucuugcaaagcggagccaguccucggcaccucagaauguaaagucccauuucugcaacaucaacuugaccuuuuuuuuuuuaucaacacucaagauggauuugagagcugucaucguuauauugguugcugcauccgcgcuaccagccuacgcucaagaaaaugggaccaaccugcuuccacgaacaaaaagaaacccuacaaagcuucgucauucacgacguuucgccgaaagaaugcccaccucuucuuacuaugaugauuauccgccagcuaccaauagccagagucaggaaaaucauaaaccaaucuucaccaacugcucaauguaucaaccuucuguaccagaagagcugacacauaccaccacuguuauacagguuaccgcggcugacaaagauccgccagaaucaggagggaaaguaaccuauacuuucguugcaacuccacaagaaagucaaaaauuuaauauugauccugaaacggggguuauuacuaccagacauagcuuugauagagaugagccaaaucgagaaaaagaaguuuauuuaacaguucgagcgacugauaauggaaggccucagcuugaugaugucuguacauucaagguuauuauugaagauauuaaugauaacgcuccaguauuugauaaaguugacuaccaagaaucuguaccucaagauuuacccccuaaacgugaaguaaugagaauaucugccacugacguugaugauggaaauaacaguauuguaauguacagcuuagaaccaagaucugcagauauguucaacaagaccuauuuucaaauugacaguaagacaggugugaucacccuugaucgagugauugaucgugauccugguuauaaauuuaaacuuagagcaacagccacagaucauggggauauccccaagucagcuguuauuaaccuggauauucaaguaguugaaucuaauaagaaagcuccugucuucacaucaauaccagcuucaccuauuguucuucuagaaaauuucaccgauuuuacugaaaauauugcuacuuuaacugcuaugucuaaugacgaaaaagcuccuguuuuugaacuaguuacgggaagaacagagcaaaccaauaaauacaguacuuuucgguuagaaucugaugcaaauacugcucacauaaggcuugcuagacgaauggauuaugaaucaaucgcugaauauacucucacuauucgaauacagaacaaauucaaucuggcuucagaaacuaguauuaauauccaguuagaggaugucaaugauaauaucccugccuuuacugaaguaguaucagguguuguauuagaaaaugaacccgcugggacuccagucaugcaagucagggcuauugaugcagacaguaccacugcucauaaucaggucacguaugaauuggcugauaauaaagaaaauuuugcuauugauagauacacugguaacauuacuacaaaaaagauguuugauagagaggaacaagauuuuuauaauguuaaaguuauugcuacugauaauucuccuucugcauuauauaaaacuggaguaccuaaugaaggucaacagguguuucgaauugaaauagcugauaagaaugaucacccuccaaaauuuacugaagcaguauauauugcugaagcuaucccugaaaaugcuaauacaaaugcucguguuacccaaguuaaugcucaagacaaugauacugccucgcuugugcacuauaguauauuuuaugguaaugaaaaugaugcauuuguaauugaugaaacuacuggugaaauccgugucaauaagaauuuagauuaugaaaccaggaccaauuauacuuuaaaaguuaaagcauuugauggagcuuaugaagauaauugugaggugcacauaaaaauugaaaauguaaaugauaauccuccaguuuuuguuucuuaucaaaaaaccauuacuauaauggaagaagaauuauucccaggaugcauugcucagcuugaagcuuaugauccagauauuccugauagaagugcaccucagcauauacuuuauuuuguuguaaaacaacagcaaaguaugugguuaaauaucaacaaaaaagguugccucucacugauaaagccuuuagauagagauccuccuaaugguacugagucuuggcaaguuuugauuggugccaaagaugaagauggugggcccacggggguacaacagaccacugaagucauuauuauguuaaccgacauaaaugacaaugcuccauacuuagacaugucacaaccaguaauuuggacagaaaaugaacccccuggagacauugugaaauuaaaugcugaagauaaugaugguccagaaaacgguccaccuuucacuuucaauauugcuccaucugcuagcacugaaauccagaccaaauuuacuauaucagguucaacuuuaaaaucacuugucagguuugaucgugaagagaggaaauccuauuuuguacccauugcuauuacugauaguggcaacccuaguuugacugguacaagcacauuacauguugucauuggcgauguuaaugacaauccaaugaaaaguggauauagugaaauuuucguuuacaauuacaagggagaggccccagauacagaaaucgguagaguauauguagaagacccugaugauugggauuuaccugacaaacgcuuugaaugggcugguauggccaguccauauuuuuauuuagauccaaagacuggcaugaucacaaugucgcaaggaacuguugaucaaucauauguccucaacuuuacuguuuuugaaaauacaaccagauauuucagugcucacaguguaucagcuaccgucaauguuacugucaaagaaauaccagaagaagcuguugauaagucagguucuguucguuuaguuggaauuacugcugaagaauuuauagaagcuaauucuaaugguaucagcaagagaacuauguucaggaaauauuuagcaaaauucuugaacauuacugaagaaaauguugauguguuuacuguuuuacauucuccacacaauacaaauacaagucuacuggauguucgauuuucagcucaugguucuccuuauuauaguccagaaaaacugaaugcagcagugagcgugcauaaugcugaauuggagaaagagcuuggaguugcgauucucauggugaacauagaugaaugucucauugaaaggcaguacugugaggguucauguauuaauuuucugaauaaaagucgugagccgaucgccguuuacacuaauacaacaacuuuuguuggugugagagcuguuguagauccuuuuuguaauugugagguacuuucaaggccaguuuguuauaauggugguacacuuauuaacgacaagugugaaugugaaccuggcuuugaaggaccucauugugagauccuaaguguuggauuuaauggaaauggaugggcccuuuauccuccauuagaaucuugugcugauucacaucugucuuuggaacuucguuccaauaaaaaggauggucuuguguuuuaccuagggccaacuaaaccgaaucgacuuuugaaugugcaagauuuuauaucucuugaggugguagauggcuacccaguucuucuauuggauuuuggaacugguacuguaaaacuagaucccaaacaaaucagacuugaugauggagagcagcaucguaucgacauaauaugguccagaacaacuauugaauuacaaguugauaacugcaagcuaccuucauguuuaagccuaaaauuaaaagcaggugacaaugaauuuuugaauguaaauggaccauuacaaauaggaggcucauuuguugauuuuaauuaccuugacaaucacaugaacuggacuuauaaaccugcaagaguaggguuuagugguuguguuaaaaaugucaccuuuaauaacaaauuguauaaucuuggaaugccuggacauucgaaaaaugcagacauugguuguaaugcugguauugcaguugcaguuucuuuuggaauagauccuaguuuuauaauugccauuauuaucugcuuagcuauauuacuaauucuguugcuggcagugguuguccaucguagaaaaacugaugaccuguauaaagacacugacgauauuagagaaaauauuauuaauuacgaagaugaagguggcggugaaggugauaugacagcuuaugacuuaaaugucuuaaggcucauguacaaugaugcaaugcaggacaaaccucuuccagaucauuugaauucuaggccagaugaaguuccugauauaugugguuuucuggauggaaaaaaacagucuguugauaaugauccugaaacuaauccuuuugaugauguuaggcauuaugcuuaugaaggugauggaaauacuacugguucucuaucaucauuagcuucaggaacugaugaaggugauuugaauuuugauuauuugucuaacuuugggccacguuuccggaagcuugccgauauauaugggaaagauucuagugaugacgaugaugaugaugacaauuaucaaacuacugcaucugaaagcugguguuaa

SEQ ID NO: 290 - RNA, 1107 nt, Nevara viridula
augucugacgaggaguauucggaguccgaagaggagacuguaccagagcccgagccucaaaagaagacugagggcgauggagauccagaauuuguaaaacgccaggaagcuaaaacaucagcuuuggaugaacaacucaaggacuacaucgcagaauggagaaaacaaagagcgaaagaggaagaggaccugaagcgccucaaagaaaagcaagccaagagaaaggucaugagagcugaagaagaaaagaggcucgcugaaaagaaaaagcaagaggaagaaaggcgagucagagaagcugaagaaaagaaacagagagauauugaagaaaagaggcguagacuugaggaagcagaaaaaaaacgacaggcuaugauggcagcucuuaaggaucaaaguaaaagcaaggguccaaacuucacaaucagcaaaaaggaagcuggucuaaacuugucuucagcacaaauagaaaggaacaaaacaaaggaacaauuagaagaagaaaagcguauuucccuuagcauaaggauuaaaccauuaaguauugaaaaucuuaacauugacagauuacgauuaaaagcuauugaacucugggauugcauuguuaaacuggaaacugagaaauaugaucuugaggaaagacaaaaacgucaagauuaugaucuuaaagaacugaaggagagacaaaagcagcaacugaggcauaaagcacugaagaaagguuuagacccagaggcuuugacuggcaaauauccacccaaaauucagguugcaucuaaauaugaacguagaguugacacaaggucauaugaugacaagaaaaaacuuuuugaaggcgguugggaaaccuugacugcugaagaauuagaaaaaauauggaagucgagauaugaacaauuuacuaagcgaaaacaugcuaaauugcccaaaugguuuggugagagaccuggcaaaaagaaggaugcuccugaaagcccugaagaggaagaaguuaaaccaaccgaugaugauguagaaccagucuaugcugaagaagaagaggcagaggaagaggcagaggaagaagaagaggaagaagaagaggcagaagaagaagaagaagaagaa

SEQ ID NO: 291 - RNA, 852 nt, Nevara viridula
auggacgcgaucaagaagaagaugcaagcuaugaagcuugagaaggacaacgcgauggaucgcgcccuccugugcgagcagcaggccagggaugccaaccugagggcagagaaggcugaggaggaggccagguccuugcagaagaagauccaagccauugagaacgacuuggaccaaacacaggagcaguugaugcaggucuugcagaagcuugaggauaaggauaaggcucuccaaaacgcugagagcgaggucgccgcccucaacagacguauccaacuguuggaggaggaccucgaaaggucugaggaaagauuggccaccgcaacagcuaaacuggccgaagccucccaagcagcagaugaguccgaaaggcagagaaagguucuugagaaccgcagcuuggcugaugaagagcgcauggacgcacuugaaaaucagcugaaagaagccagauuucuggcugaagaagcugauaagaaauaugaugaggucgcucguaaauuggccaugguugaggcugauuuggaaagagcagaagagagagccgagagcggugaaucaaaaauuguagaacuugaggaagaacuccgcguuguugguaauaacuugaaaucacuggaagugucagaagaaaaggcaaaccagagagaagaagaguacaagaaccaaauuaagacccuuacaaacagacuuaaggaggcugaagcucgcgcugaauucgccgagcguuccguucagaaauugcagaaggaaguugacaggcuggaggacgaacuuguccacgaaaaggagaaguacaaauacaucugcgacgaccucgaccagaccuucucagaacuugucgguuaa

SEQ ID NO: 292 - RNA, 789 nt, Nevara viridula
auggcugucgguaaaaauaagggacucuccaaaggaggaaagaagggaguuaagaagaagguaguugacccuuucacaaggaaggauugguaugauguuaaggcuccaucaauguuuaauacccgucaaaucgggaagacucuugucaacagaacacaaggaacuaaaauugcuucugaaggacucaaaggucgaguuuucgaggugagcuuagccgaucuucagaaugauacugaugcugaaaggucauucagaaaauuccgucucauugcugaagauguucagggcagaaauguuuugaccaauuuccaugguauggacuugaccacagauaaacugaggagcauggugaaaaaguggcaaacauuaaucgaagccaauguugauguuagaaccacugacggauacuuguugagaguuuucuguauuggauucacuaacaaggaccagaugucucagcguaaaacuuguuaugcccaacacaaccaggucagagcuauuaggaaaaagaugguugacaauauuacaaacaacauuaguaacagcgauuugaggguuguggucaacaaauugauccccgauuccauugcaaaagacauugaaaaaauaugccaaggcaucuauccucuucaugaugucuacauuaggaagguuaagguacugaagaaaccaagguuugaguugagcaaacuucuugaacuucauggugaugguaaaggcucugaugaaccugguucuaagguuucaaggccugaagcuuaugaaccuccaguucaggaaucaguuuaa

SEQ ID NO: 293 - RNA, 663 nt, Nevara viridula
auggggagaagaccugcucgguguuaucguuacuguaaaaauaaaccuuacccuaagucaagguuuugucguggugugccagaucccaagaucaggauuuuugaucuuggaaagaaaaaggcucguguugaugauuuuccauuauguguacaucuuguuucugaugaauaugaacaacuuucaucagaagcucuugaagcaggacguaucugugcaaauaaauauuuaguaaaaaauuguggaaaagaucaauuccacaucagaaugagauugcaucccuuccaugucaucaggauaaacaaaauguuaucgugugcuggagcugauaggcuccagacugggaugagaggugcuuuuggaaaaccgcaggguacuguagcuagaguacacaucggucaaccuaucaugaguguccguuccagugacagauacaaggcugcugucauugaggcacucaggagagccaaguucaaguuuccaggaaggcagaagaucuauguuucuaagaaaugggguuucaccaaguaugaccgagagacauuugaggaacugagggcugauggaaaauuggcgaaugaugguugcaauguuaaguacaggagagaucaugguccuuuguccaauuggaaaaagguucaaguugaacuggcagcugcuaguuaa

SEQ ID NO: 294 - RNA, 714 nt, Nevara viridula
augacuugcgcgacucccauaucgaagaaaaagaaguuuguggcagauggaguauuuagagccgaauugaaugaguuuuuaaccagagaacuagcugaagaagguuauucugguguugagguccgugaaacuccuagcaggacugaaauuauuauuauggccaccagaacucaaaguguucuaggagaaaaaggaaggcguauuagagaauuaacuucaguugugcaaaagagauuuaacuuucagccacaaucuuuagauuuauaugcugaaaaagucccaacuagagguuuaugugcuauugcucaagcugaaucuuugagguacaaguugauagggggucuggcuguccguagagcuuguuauggaguucugagauucaucauggaaaauggagccaaagggugugaaguaguaguuucaggaaaacuuagaggccaaagagcuaaguccaugaaauuuguugauggccuuaugauccacaguggugacccauguaaugaauauguaaauucagcuacccgccauguauuauugagacaaggaguacuugguaucaaaguuaaaauuauguuaccaugggauccaacaggaaagaauggaccuaagaauccucugccugacaacguuuguguugucaauccuaaagaugaaauuauuccuucugauauuaagacuaugggaaucgaauuacauccaccagcuauuauuuaa

SEQ ID NO: 295 - RNA, 354 nt, Nevara viridula
auguccaaggcagaauuagcuuguguauacucugcacucauccucgccgaugacgauguugccguaacuggagagaaaauccaaaccauccucaaagcagccagcguugacauugagcccuacuggccuggccucuucgccaaagcccuugaagguaucaacgucaaggaccucaucaccaacaucagcagugguguagguguuggcgguggugcuccagcagcugcugcaggcggugcugcacccgcugcugcugcugcuccagccgguggugacaagaagaaagaagagaagaagaaggaagagagcgaaccugaaucagaugaugauaugggcuucggucuguucgacuaa

SEQ ID NO: 296 - RNA, 657 nt, Nevara viridula
augaguuuucuuagcaaaguuuuccuuggcaaaaaggaagaaaaagcacccacagcuucugaagcuauacaaaagcuucgcgaaacugaggauauguuaauuaaaaagcaggacuuuuuggaaaagaaaauugagucugaauuaggucuugugaagaaaaaugguacuaguaauagaagaguugcaauucaagcucuuaaaagaaaaaagagguaugagaaacaauugcaacaaauugaugguaccuuggcuaccauugaaaugcaaagagaagcuuuagaaggugcuaauacuaauacagcuguccuucagacaaugaaguuugcugcugaugcauuaaaaaccgcccauaaacacauggauguugaccaaguucaugauaugauggaugaaauugcugagcaacaagaugucgcaaaagaaauaucggaagcuauuucuagcccugucgcuuuuggaaaugacauugaugaggaggaacuugaaaaagagcuagaggaauuagaacaagaagaauuagacagagaacuucuugguacaggcccgacugcagaucaauuaccugaugucccugccacucaauuaccugcaaaaccaaagccaauugcaucagaagaugaugaagaauuaagacaauugcagcagugggcaacauga

SEQ ID NO: 297 - RNA, 456 nt, Nevara viridula
augggucgcaugcacgcuccugguaaggguauaucccagucugcuuugccauaucgucgaucaguuccaacuugguugaaacuaucaccagaagaugugaaagaacagauuuucaaauuaggaaaaaagggacucacuccuucacaaauaggugucauucuucgagauucccaugguguagcccaaguacgauuugucacuggaaacaagauucuccgaaucaugaaggcuaugggacuagcuccugaucuuccagaagaccucuauuuucugaucaagaaggcuguugcuaucagaaagcaucuugaaaggaacaggaaggacaaggacuccaaguuccgccuuaucuugguagaauccaggauucacagacuugcucguuacuacaaaaccaagggcgggcucccaccaaacuggaaguacgaguccagcacugcaucugcucuuguugcuuaa

SEQ ID NO: 298 - RNA, 1284 nt, Nevara viridula
augauucccccgucuucucggccacaggucacuguauacagugacaaaaaugaaccaacuggugaauuauugacucucccugcagucuuuaaugcuccaauuagaccagauguaguaaauuuuguucaucaaaauauugcuaaaaaucauagacaacccuaugcugucagugcugaagcaggucaucagacuucugcugaaucauggggaacuggacgagcuguggcucguauaccucguguaagggguggugguacccaucguucuggucagggugccuucgguaacauguguagagguggacgcauguuugcaccaacuaggguauggcgcagauggcaucguaaggugaauguuaaucaaaagagguaugcaaugguuucugcuauagcugccacuggagugccagcacucgugaugucuaaaggacacauggugaaugaaguuccugaaauuccucuuguagugacugauaagauucaggaguauacuaaaaccaagcaggcaacaaucuucuuacaucgcaucaaggcuuggacagauauucagaagguauacaagucuaaaagguuccgugcugguaaagguaagaugcguaauaggaggcgcauucagcguagaggaccucucauuaucuacggccaggaucaaggccuaacucgugcuuuucguaacauuccugguguugaucuuaucaacguuucacgauuaaacuuacuuaaacuggcaccugguggucacguggguagguuuguaaucuggacccaaucagcuuuugaucaacuuaaugcucucuauggcacauggaagaaaaaaucaacuuugaaaaaggacuacaacuugccaaugcccaagauggugaauacugaucugucccgacuuuuuaagucugaagaaaucaagaguguccucaaaccuccaaggaagaccauagucaggaggguaaggaaacugaacccauugaggaauacacgagcaaugcugaagcucaacccauuugcugcuguucugaagaggaaagcuauuuuggcugacaggaaacuuaagcuugagagggcuauugagagaucaaagaaggaaggaguugagcuuaccccucaucaaaagagguauguugcuaugcuugagagaaggaaagcucagaucaaagccgccaaggcugcuaagccuaaaaagguuaagaagccuaaggcugaaaaagccgcugcugaugaagcaaagaaagcugcuguaacuaaaaaaccagcaaaaaaggcugcugcucccaaaccucccaaaaaauga

SEQ ID NO: 299 - RNA, 615 nt, Nevara viridula
augacgggguuuucggacaagcccaucuuaauugauggcaaaggucaccuacuggguagacuuucagcuauuguagcuaaagcugcuuugaauggaaacagggucguuguuguuaggacggaacaaauuaauauuucaggaaacuucuucaggaguaaacuaaaguacuuaucguuuuuaagaaaaagauguaauguuaauccagccagagguccuuuccacuuccgggcacccaguaaaauuuuguauagaaccaucagggguauggugccacacaaaauugaaaggggaaaggcugcuuuaaggcguaucaaguuguuugagggaaucccucccccauaugacaaaaggaagcgaguaguagucccaacagccaugagaguuuugugcuuaaaaccugguagggcuuauugccaucuuggcagguuaucuucugaaguuggcuggaaguacaaggauguggucagggcccuugaaaccaagaggaaggucagggcaguuuuugauauucgcaagaggaauucccucaagaaauugacuaaacaagccaaggaaaagauguccaaagcgaaugcuaauuauaccgcuguaaucaauucuuauggauaucguuaa

SEQ ID NO: 300 - RNA, 3543 nt, Nevara viridula
auguccccuccagggcaucuacaaggggugguugggugugaggucgggagcccugcugcaugggauaagaugagugcugccgccaguggaucauccaccaagaaaaggaagaaacccgaaaauaaaccucagucucagauuaacaagugccuuaaugaaaagcggaggagggagcaggaaaacaucuacaucgaggagcuugccgagcuuaucuccgccuccuucacagacaugagcagccucuccgucaagccggacaagugugccauccuacaggagaccguucuucagaucaagacgauaaaggguggaggauccgcaagugaugccguccaacaaggugagguuucauccagcaagccuacuauucuaacuaaugagguuuuugggccacucuuacuugaggcuuuagaaggcuuucuguuuguugugaauccggaaggcaaaguugaguuuuguacugagaauaucacucaguucauaaaauaucgucgugaagaggugcuuggccagccgguguacaauauaauacaccacggcgaccacgcuagguuuucgucuuggcucuugccuaugagcugguccaacgacuaucauccaccaagaccuagaacauuuaacugccguuuccucaucaaaccuccuccagauacgacuguggaagaaaagcaacaaagaccguccaaguaugagaauaugcagauuuccuccacacaacuuccccaaaguaguggaguagacaaagacgacgaugguagcagcgaguccggaccuugcuugauguguguggcuagaagaauuccaccaaaugaaaagccuacggguucaccuauugagcaauucacaaugaaacugacuaccucuggaaggauuauaaauguagauaauaccggcguuucugcuccuuauucacaauacaucaguaaggauuuaaugaacagaaauuuagaagaacuaguucaaagcagcgacguucccaaaguucuaucuaauauuaaagaagcguugacuacaggacaaaguucaacggcuauuuacaaacuucuuauugccccugccccugaaaacuuucuucacguucaaacuaaauuuaagcuguuuaaaucagccaaucgccagauggagaaugacuuccuaauggcuacccauucaauauuuggagauauugauaucaauaucaauaugggaucaccugcuggcagcagcagucaggccaucgguggcaguaacaauacuaaccaaaaccaacaccaacaccaacaccaacaacagcagcagcagcaacagcagcagcaacaaagcacuucaaccagcggaguugggggcccucuuauugcuaguguuaacggagcaaauaacagagacuugaguaacacuauuacuuuaaacaauagcucugccuuccauucggucacucucaacucgaccgaucuggauuucaauuuugauauuuuuccgaguucuucgacuugggaucuuagcagugacgagagaguuugggaaaggcccgaaucucgucagaguuugacuccgguagaaaguccauuauauuccaacccaccugcucaauccccugccaccacuccauuuucaacuccauacgcuuucucaccgauucaggagacaacucaggaagaacccccggaggaagauuccggaagacuaagaaaccuccugaugaccaagaggccaucuacggaaucggaugauggcgguggaggcaacauugcucaacguaauagacacagaauauuaaaaaaucuucugaaccaggaagaugaagaaucgcaaccccaagauucgaaaccgcccaauaauauguuauugaagaaccagcagagcggugaugauggucuccuuaaaagccuuggguuccguggagaaaccagcgaggaaagcagaggaggaaggaagcgcccaucuucagaugaaagcgaagaccaaccuggcccaaaaagaucuuccucaucccuucuggaugccguaccucccccaacacccucggcgccguccgcugcgucagguaaaucgaggcuuugggagaagaaccaaaugcuugcuucucuauuggccaagcgcccgacuacuccggcaucgauuccgccuauuccagcuucugucaucuccgcuacaccgcaggauaaacugcaacgucuuguuaaacacccgcaaacaaccggcugguccggcgguagcguccacaccgcugcggcgucgcccggccauagcaggcaaggcaggagcccugguuauaacuccgcagcccacaugugggacucugcgucauccgaucccguacucucggacauccucgaucaagucaucgagauaguaccagauguuaacacagaugcgccagcucugaugaauaugaucaacucguuggaagcugagacucagcagucuguucaacaacaguucguaucucaaacagauuugaaugaaaagauggcgauuagcgcuauacaaaagucuuuaaugcucugcgaaucggcgguuaaagggccuucuuaucaaggaacgaugucgcaggguucuccaggaccacaaccccagccucaacagcaaccacaaccacaacagcaaccucagccgcagcagcaacaauuucacccuccuccgauguaucagcaaaggcagagguuuccuauccagcagcaacaacagauucgaagccaguucccccucaguccaaugauuauggcucagaggaguaaaaugcaacagcagcagcagaugcaacaaaagcagcgauuacuccacaugcagcaacaacaacagcuuguuauuccgucgaaugcgacugccucaaauaaugaccccgcacuccauaauauugauagccuuaucaauaauaccguugcuccgaacgugucgcuccagagaucgagcagcguuccugauucccagcuuuccccagugggcaauuacccaggcaugggauccguucccucaccaggccaaagaaggccuuucucaccugugaacgguggaaugaccaauuucuccaauagcggcggaggggggccaucuucuggcagcggcccucaggcgaggcucucuccuaguucuauaacgggcuaccaacagcaaccucagcugucuccaaggcucucucagggccaacaagguuauggcggugguggugcuagcuggccucagcagaauucacggcuauccuugcagcagcaggagaacccgguccucaaugcucaauugacaagcggaggacgaggguacgcaagggcuaccacagcagguuuaccucccguaagaucgcucgcuggcccucagcgguuccccacaggugcugaccagcaggccaguucuuccucguaccaauuucggcugcagcgccaggugucagcaccucagccucagcagucgucgccgaaugcccaguuaccaggagguaauaacggugucaccgaguacguaagacaagagcugcgugcgauggucggcgccagaaccaguggaagugggcguccucagguucccggcucucuuccccuaccuacgccugcgguugaccucgauucu

SEQ ID NO: 301 - RNA, 411 nt, Nevara viridula
auggggaagauuaugaaaucugguaaaguuguguuggugcugagugguagauaugcuggaagaaaagcaauugugcuuaaaacuugugaugaaggaacucaagagaaggcauaugggcaugcaauaauugcaggcauugaucgcuauccccgcaaaguucauaagagaaugagcaaaacaaaaauccacaagaggucuaagaucaagccuuucuugaagguuaugaacuacaaccaccuuaugcccacucguuacacaguaucugagaucgccccugaccagaagguuguuacgaaagauuugaaggacccaaugaagaagaagaaaauacguuuccaaguuagggugaaauucgaagaaagguacaagcaagguaaaagcaagugguuuuucgaaaaauuaagguuuuaa

SEQ ID NO: 302 - RNA, 510 nt, Nevara viridula
acaaaaaauaguaugcgagaguuacacauucgcaaacucugccuuaacauuuguguaggagaaucuggugacaggcuuacuagagcugcuaagguauuggaacaacuuacaggacaacaaccuguauuaucaaaagccagauacacugucaggucuuuugguauccgucguaaugaaaaaauugcuguacacugcacaguaaggggagccaaagcugaagaaauuuuagaaagaggcuuaaaaguuagagaauaugaauugagacgugauaacuucucugcaucuggaaacuuuggauuugguauucaggaacacaucgaucuugguaucaaauaugauccaaguauagguauuuacggucuugacuuuuacguaguauuaggaagacccggauucaacguagcccacaggaggucaaagacugguaaaguuggauucucacacagauugacaaaagaggaugccaugaagugguuccaacagaaauaugaugguaucauccuuaacagc

SEQ ID NO: 303 - RNA, 5874 nt, Nevara viridula
auggcgucgaaaggaccugcagguaugcaaguaggggcugaugaccccgauccaaccccauaucucuucguaucucuggaacagaagagaaucgaucaaacgaaaccauacgacgccaagaaggcuugcuggguccccgaugaagccgaagguuuccuccagggugaaauccaaggaaccaagggagauauugucucagucaagcuccccgguggcgaaacaaaagacuucaagaaagaucuggucggccaagugaacccacccaaguucgagaaaugugaggacauguccaacuugaccuaccucaacgacgcuucuguccuguauaaccuuaagcagagauacuaucauaagcuaauuuacacauacuccggucuguuuugcguugcuaucaacccuuacaagagauuccccguauacaccaugaggugcgccaaguuguacagagguaagaggaggaaugaagucccaccucacaucuuugccaucucugacggugcuuacguaaacauguugaccaacaaagaaaaccagucuauguugauuacuggagagucuggugccggaaagacugaaaacacgaagaagguaauugccuacuucgccaccguuggugccagcacaaagaaagaagaaguaucagaaaagaaggguacccuagaagaucaagucguccaaacuaacccuguacuagaagccuuugguaaugccaagacaguccguaacgauaacuccucucguuucgguaaguucauccguauccacuucggaccaucaggaaaacuggccggagcugauauugagaccuaucuacuggagaaggcucgugucaucucccaacagacucuggaaagauccuaccacauuuucuaccagaucaugucuggugccguaaagggagucaaggaguuaugucugcuguccaacgacauuuacgaauacaacuacgucagccagggaaaaauuucuauugcgggagucgaugacggagaggaaaugcaguugacagaugaagccuucaacgucuuggguuucacccagcaagagaaggaugacaucuacaagaucacugcugcuguuaugcacauggguugcaugaaguucaagcagaggggucgugaagaacaggcugaagcugaugguguggaagaagguaucagggucgguaagcuccucggagucgauggugaagaacuuuacaagaacuugcugaagcccaggaucaaggucgguaacgaauucgucacccaggguaggaauguaucucaggucacauacucaguuggugcuauguccaaggguauguuugaucgucucuucaaauucuuggucaaaaaauguaacgagacccuggacacaaaacagaagaggcagcacuucauugguguacuggauauugccgguuuugaaauuuucgacuucaacgguuucgagcaacuuugcaucaacuuuaccaacgagaaacugcaacaguuuuucaaccaccacauguuuguguuggaacaagaggaauacaccagggaaggaauugagugggcuuucaucgauuucggcauggacuuggccgccugcauugagcucauugaaaagcccauggguauccucucaauucuugaggaagagucuauguuccccaaggcuaccgauaagaccuuugaggacaaacugaacaccaaccaucuaggcaaaucucccaacuuccagaagcccaaaccaccaaaaccagguugccagcccgcucacuucgccaucggucacuacgcugguguuguaucguacaacaucacaggaugguuggaaaagaacaaggacccucugaacgacacugucguugaccaguacaagaaggguuccaacaagcuguugugcgaaaucuucgcugaucacccaggacaguccgguggugcuacucaggaugcugguggcaaggguggccguggaaagaagggugguggcuucgccaccguaucuuccuccuacaaggaacaauugaacaacuugaugaccaccuugaggagcacacaaccccacuuuguccguuguaucauucccaaugaauugaaacagccaggugucaucgacucucaccuggucaugcaccaacugaccuguaacgguguacuugaagguauccguaucugucguaaagguuuccccaacaggauggcauaccccgacuucaagcuccgauacaagauccuuaacccagcugccguugauaaauuaaccgacgagaaggcgauggcuggagucaucuuggaauccacagggcucgaucccgacauguacaggcuuggccacaccaaggucuucuucagggcugguguccugggucagauggaagaacuucgugaugaaaggcucagcaggaucaucuccuggaugcagucauacauccgugguuaccucugcagaaaggaauucaagaaacuccaagaacagagacucgcccuccagaucguccagaggaacuugagaagguaccugaauuugagaacauggaacugguggaagaugugguccaaaguaaagccccugcucaacguagccaacguagaggaagagaugaggaaacuggaggaguuggucgcucaaacccaagccgcccucgagaaggaagagaaagcaaggaaggagguugaggcccucaaugccaagcugcuccaggagaagaccgagcucuugaggaaccucgagggagagaagggcacacuuggaagccuucaagaaaggucugccaagcuccaggcccagaaggcugacuuggagucccagcuuauggacacacaagaaagacuucaacaagaagaggacgcaagaaaccaacuguuccagcaaaagaagaaacuugaacaagaaaacggcagucucaagaaggacauugaggaccuagagcuuuccgucaccaagagcgaccaagacaaggcuagcaaggaacaccaaaucagaaaccucaaugaugagauugcccaccaagacgaacucaucaacaaacucaacaaagaaaagaagauccagagugaacacaaccagaagacugccgaggaacuccaagccgccgaagacaaaaucaaccaccucaccaaagucaaaucgaaacuugaacagacuuuggaugaacucgaagacucacucgaaagagaaaagaaacuucguggagauguugagaaggccaagaggaagacugaaggagaccucaaacuuacccaggaagcuguugccgaucuugaaaggaacaagaaggaacuugaacagaccauccagaggaaggacaaggaaauggcuucccucacugccaagcuugaagaugaacaagguaucgucaacaagacuggcaaacagaucaaggaacuccagucccgaauugaagaacuugaggaagaaguugaagccgagagacaagcccgcggaaaggccgagaaacaacgugccgaccucgcccgcgaacuugaagagcucggugagagguuggaagaagcugguggugcuacuuccgcccaaaucgagcucaacaagaagcgagaagcugagaugagcaaacugaggagggacuuggaggaagccaacauccaacacgaaagcacccucgccaaucuccgcaagaagcacaacgaugccgucagugaaaugggugaccaaauugaccagcucaacaaacucaagaccaagguugagaaggaaaaaugccaauaccugugugaauugaacgaucuucgugccuccaucgaccauuugaccaacgagaaggcugccacugaaaagauugccaagcaacuccaacaccaacucaacgaaguccaaggaaaacuggaugaagccaacaggucucucaacgacuuugauucugccaagaagaaguugucaauugagaacucagaucuccucagacaacuugaggaggcugagagccaaguaucucaguugagcaagauuaagaucucccucaccacccaauuggaagacacuaagaggcuugcugacgaagaggcuagggaaagagcuacccuucugggcaaguuccgcaacuuggaacacgaccuggacaaccucagagaacagguagaggaagaaucugaagcuaaggcagauauccagagacaauuaagcaaggcuaaugcugaggcucaacucuggaggcauaaguacgagagcgaagguguugccagggcugaagaacucgaagaagccaagaggaaacuacaggccaggcucgcugaggcugaggaaacuauugaaucucuuaaccagaaagucauugcucuugagaagaccaagcagaggcucgccaccgaagucgaagaucuucaacuggagguugaccgugccaaugccauugccaaugcugccgaaaagaaggccaaggcuaucgacaaaaucauuggugaauggaaacucaagguugaugaccuugcagcugaacuugaugcuagccaaaaggaaugcaggaacuacucgacugagcucuucagguugaaaggagcauaugaggaaggacaagaacaacuugaagcuguccgcagggagaacaaaaaccuugcugaugaagucaaggaucuccuugaucaaauuggugaggguggacgcaacauccacgaaauugagaaacagaggaagaggcuugaaguugaaaaggaugaacuccaagcugcucucgaagaagcugaagccgcccuugaacaggaagaaaacaaaguccucagggcucaacuugaacucagccaaguuaggcaagaaauugaucgucgcauccaggagaaggaagaagaauuugaaaacaccaggaaaaaucaccaacgugcccucgacucuaugcaagccaguuuggaagcagaagccaaggguaaggcugaggcacuccgcaugaagaagaaacuggaagcugacaucaacgaacuugaaaucgcucucgaucaugccaacaaggcuaaugcugaagcucagaaauccaucaagaaauaccagcaacaacuuaaggauguccagaccgcacucgaggaagaacaaagagcuagggaugaugcccgagaacaacugggcauugccgaaaggcgagccaaugcucuuggaaacgaacucgaagaaucaagaacucuacuggaacaggcagaccgcggccgucgccaggcagaacaagaacuuaccgaugcucacgaacaaaucaacgaacucgcagcucaagccacaagcgcuucugcugccaagcgcaagcucgaaggagaguugcagacacuccaugccgaccucgacgaacuucucaacgaagccaagaacucagaagagaaggcuaagaaggcuaugguugaugcugcgagguuagcagaugaacucagagcugaacaagaccacgcccagacccaagagaaacuccgaaaggcccucgagacacagaucaaggaacuccaagucagacuggacgaagccgaaaacaacgcccucaagggaggcaagaaggccauugccaaguuggaacagagagucagggaacucgaaaacgagcuugauggagaacagaggagacacgcugacgcccagaagaaccuccgcaaaucugagcgcaggauuaaggagcucagcuuccaaucugaugaagauaggaagaaccacgaacgcaugcaagaccuuguagacaaacuccaacagaagaucaagacuuacaagaggcagauugaagaagccgaagaaaucgcugccuugaaccucgccaaauuccgcaaagcccaacaggaacuugaagaagcugaggagagagcagaccuugccgaacaggcuguuacaaagcugagaacgaaaacuggcggcagagcuggaucaacugcaagagccaugagcccagugggccagaaacaaaggagaguaccaauugauuuggaguaa

SEQ ID NO: 304 - RNA, 768 nt, Nevara viridula
augaguucgauaggaacuggguaugaucugucagcgucacaguuuucuccugaugguagaguuuuucaaguugaauaugcacaaaaagcuauugaaaauagugggacugucauaggucugcgaggcaaagaugguguuguuuuagcuguugaaaaguuggucacaucaaaauuauaugaaccgggugccaauaaaagacuuuuuacuauugacaaacacauuggaauggcuguagcaggucugauuucugaugcuagggcaguugcagaaguugcaaggacggaagcugcuaauuacagaucucaauacaagagcaguauaccucuuaaauacuugaaugagcgagugucuauguauaugcaugcuuauacacucuacagugcuguaaggccauuugggugcagcguuauacucagcacuuacacagaagaagacgguccagaaauguauaugauagauccaucaggaguuucauaugguuauuuugguugugcuguugggaaggcgaagcaagcugcaaaaacugaaauugaaaaauuaaaacugaaagauaugucaugucaggagcuggugaaggaagcagcccgaauuauuuaccuuguccaugacgaauuaaaggacaaacaguucgagcuggagaugagcuggauuggcucucagacaagugguguaaaucaacaagucccugcuaauguucaugcugaagcagaaaaagaugcuaaagcugcgauggaagaagacuccgauucagaaacggaagauauauaa

SEQ ID NO: 305 - RNA, 804 nt, Nevara viridula
augguugaaacaucaguaguuaguccugcagcaccugcugcaggcaauaagaaggcgagcucaaccagaaagccucagcguaggaauuacaaucuugguuccggaguuuacagguuuagcagaacucgcauguuucauaagaaggccuuguggaaauuuauugguaagaaaaccccuaagaccccacgucccaaaaggaaaacuacucuugaaaaaaaaauugguggugagaagaauggagguacucguacugucuauuuaaagaagaggacaaaaucuuauccuaccacuaacaaggugagaaaacacccaagcaaaacauauuuuucucagcacaagagacgauuccgugcaucacuaaaacccggugcuauugugauucugcuugcuggacugcacaaaggaaaaagggcaguacuuuuaaaaaauauggcuaguggacuucuccuuguuucugguccauucucuuugaauggaguaccucuuagaagaauacaucccaacuauguuauagccaguucaacucaaauugaucugucugguguuaaauugccugagcauaugaaugauagguacuucaagagaguuaaagcaaaaaaggccaagaaaacugauggugaaaucuuugcugcuaaaaaagaaaucuacaaaccauccgaacagaggaagaccgaccagaaagagguagacaaacagauuuugcaggcuauuaagaaacaugaacauagucuacuucuaaggaaguaccugugcacaauguuuggccuucgaagcagucaguauccucacaggaugaaauuuuaa

SEQ ID NO: 306 - RNA, 732 nt, Nevara viridula
augucuaccaaagacaaauugcccauuuucccuucucgaggugcucagacuuugaugaaaggaagacuugugggugcacaaaaaggucacaguuuguuaaagaaaaaagcagaugcccugcaaauuagguuuaggaugauccucagcaaaauuauugagacaaaaacucugaugggagaagugaugaaagaagcagcuuuuucauuggcugaagcaaaguucgcuacuggagauuuuaaccaacaaguuuuacaaaauguacagaaagcucaaauaaaaauuagaacaaagaaggauaauguugcaggugugacacugcccguuuucgagagcuaucaagauggaacagauuccuaugagcuggcuggauuggcuagaggaggacaacaguuagcgaaacuaaagaagaauuaucaaaaggcgauaaaacuucucguagagcucgcuucauuacaaacaucuuuuguuacgcuagaugaaguuaucaagcuuacgaacagaagaguuaacgcuauugaacacguuauuauacccagaauugaacgcacacuucaguauaucauuuccgaauuggaugaguuggaaagagaagaauucuauagauuaaaaaagauucaagauaagaaacguaucgcucgucaaaaagcugaagcaaagaaagcaguggacgcugccgcagcaacgauggcgagcaacauucucgaagaaaacgaugaggaccuccuauuuuaa

SEQ ID NO: 307 - RNA, 666 nt, Nevara viridula
auggccccaagaggaaauaauaugaucccuaauggccauuuccauaaggauuggcaaagauuuaucaagaccugguuuaaucaaccugcucgcaaguaucgccgaagaauaaagagggucaagaaagcuagggccuuggcuccaagaccagcaacuuuacugcguccugcuguuaggugcccuacugugcgauaccacacaaaauugagggcuggcagaggcuucacauuagaagaaauuaagaggguuggauugugcccuggauuugcgagaucuaucgggauugcugucgaucacaggagaaggaacaagucagucgagucuuuacaauuaaauguacaacgucugaaggaguaucaagcuaagcuaaucuuguucccaaccaagaagagcaagaaggugaagaagggagaggcuucggccgaagaacaagcuuuagcuacccagguaucuucaccugugaugccgaucaagcaaacuguuguaaaauauaaagccagaacuauuacuccugaggauaagagcuucucugcuuauggagcuuuaagaaaggcaagggcugaugugagacuuguuggaaucagagcuaaaaggcuaaaggaagcagcugauaacccugaaacuguugagaaggcugcuaaacagaagaaaguuaaagcaaaauaa

SEQ ID NO: 308 - RNA, 537 nt, Nevara viridula
auggauggauuauuauuggaaccuacucuuuauacuguuaagggaauggugauuuuggacaaugauggacacaggauauuagcaaaauacuaugauccaagugucuuuccaacuucuaaggaacaaaagggauuugaaaagaauuuguuuaacaagacucaucgagcuaaugcagaaauaauuauguuggauggacuuacauguguuuauaaaucuaauguugauuuauuuuucuauguuaugggaaguucacaugaaaaugaguugauauugaugaguguacuucaaugccuuuaugauucaauaagucaaauauugagaaaaaauguugaaaaacggacucucuuagaaaauuuagaaauuguaauguuagccauggaugaaauuugugauggaggaauaauauuagaagcugauccaacgaguguuguucaaggaguagcuuugaggacagaugauaucccacuuggugaacaaacuguugcucagguucuucagagugcaaaggagcaaauuaaaucugcaauauuaaaauaa

SEQ ID NO: 309 - RNA, 549 nt, Nevara viridula
auggggaauauguuugcaaauuuguucaaaggccuguuuggcaaaaaggaaaugagaauacugaugguuggucuugaugcugcuggaaaaaccacuauuuuauauaaacuuaaauuaggagaaauuguaaccacaaucccaacuauuggauuuaauguugaaacuguugaauauaagaacauaaguuucacagucugggauguugguggucaagacaaaauucgacccuuguggcggcauuauuuucaaaauacucaggggcucauuuuuguuguagacaguaaugauagggaacguauuggugaagcgcgagaagaacugaugagaaugcuggcagaagaugaauuaagggaugcaguucuucuuauuuuugcaaauaagcaggaucugccaaaugccaugaaugcagcugagauaacagacaaacucggccuacacucauugcgcaaucgcaacugguacauucaagcgacgugugcgaccucaggcgauggucuauaugaaggccucgauugguugucgaaccaacugaagaaugccaaccgcuag

SEQ ID NO: 310 - RNA, 384 nt, Nevara viridula
augacugaugaaguuaauccuaaagccuacccauuggcugaugcuacccucacugcuaagauauuaaauguugugcagcaagcucugaacuacaagcaguuaaggaaaggugccaaugaaucuacuaaaacuuugaaucgaggauuagcagaguuuauagugauggcugcugaugcagaaccacuagaaauauuauugcauuuaccucuauuaugugaagacaaaaaugugccauauguuuuuguccguuccaagcaagcucuuggaagagcgugcggaguuucucgaccuguugucgcuuguucagugacugucaaugaaggaucucagcucaagccacagauaacaaaaauacaacaagacauagagagacuuuuaguguaa

SEQ ID NO: 311 - RNA, 1302 nt, Nevara viridula
augcccgauuaucuuggugaugauaugagaaaaacaaaagaggagaaggaagaagaaaaggauauuaaaucucuugaugaagcugauaucgcuuuacuuaaaacuuauggacagggucaauacacaaaaagcauuaaaaguguugaagaugauauacagacgauaaucaaacguguuaaugaacuaacagguauuaaggaaucagauacugguuuagcuccuccugcucuaugggacuuggccgcagauaagcaaauacuccaaaaugaacagccucuucagguugccagauguacaaaaauuauuaaugcugauucugaagacccaaaauacauuauaaauguaaagcaguuugcgaaauuugugguugacuuagcugauucaguugcaccuacugauauugaagaagggaugagagucgguguugauagaaacaaauaucaaauucagauaccucuuccaccaaaaauagauccaacuguaacuaugaugcagguugaggaaaaacccgaugucacuuacagcgauguuggugguugcaaugaacaaauugaaaaauugagagaaguaguugagacaccuuuguuacagccugaaaaguuugugaauuuaggaauugaaccaccaaaaggaguucuucuuuuugguccuccugguacaggaaaaacacuuugcgcuagagcaguugcuaauagaaccgaugcuuguuuuauaagaguaauugguucagaacuuguccaaaaauauguuggagagggagcaagaauggugcgugagcucuuugaaauggcuagaaguaaaaaagcuugccuaauuuuuuuugaugaaauagaugcuauugguggagccagguuugaugacggagcugggggugauaaugaaguucaaagaacaauguuagaacuuaucaaccagcuugaugguuuugaucccagggguaacauuaagguuuuaauggcaacaaauagaccugacacuuuggacccugccuugaugagaccuggaaggcuggacagaaaaguagaguuuggacuaccugaucuggaaggucguucucauauuuucaaaauucaugcacgcucaaugaguguagagagagauauucgauuugaguuacuugcuagacucugucccaauaguacaggagccgaaaucagaucgguuugcacagaagcugggauguuugcaauucgugcucgaaggaaaguugcuacagaaaaggauuuccuugaagcaguaaauaaagugauuaaaucuuaugcuaaauucuccgccacuccaagauacaugacauauaauuaa

SEQ ID NO: 312 - RNA, 444 nt, Nevara viridula
augaagaugaacaaguuagugaccucuucuaggaggaaaaaucgcaaacgucauuucacagcaccaucucauauuagaaggaaauugaugucuucuccucucuccaaagaacuuaggcagaaauacaauguccgcaccaugccuguuaggaaagaugaugaaguucaaguuguuagaggacauuauaaaggacagcagguaggcaaaguuauucagguauacagaaagaaguuuguuauuuauaucgagagaauucaaagagagaaagccaauggugccaguguguauguuggcauccacccuuccaaaacggucauuguuaaacuaaaaauugacaaagacaggaaagaaauuuuggauagaagauccagaggaagagcucuagcccuuggaaaagacaaaggaaaguacaccgaugagaacacagcaauggauacaucuuaa

SEQ ID NO: 313 - RNA, 1698 nt, Nevara viridula
auggcugugguggaacaaccuuguuauacucugaucaauuuuccaucugauuuagagccuccuaaugaaaugcagcuaaaaucugauuuagaaaauggagacacuaaagcgaaaauugaagcuuugaaaaauauuauucauuuaauugcaaauggagagcgucuaccugguuuacuuaugcauaucauacguuuuguuuugccaucacaagaccauaccauaaaaaaauuacugcuuauauuuugggaaaucguuccuaaaacuacuccagauggcaaacuucuccaggaaaugauuuugguuugugaugccuaucggaaggacuuacaacauccuaaugaauuugucaggggaucuacauuacguuuucuauguaaacuuaaagaaccugaauugcuugagccuuuaaugccugcuauaagagcuuguuuagagcaucggguuucauauguacgaagaaaugcaguacuugcaauauuuaccauuuauaggaauuuugaauucuuagcuccugaugcaccagaacuuauugcuaauuucuuagauggggagcaagacaugucauguaaaagaaaugcuuucuuaaugcuccuacaugcugaccaagaacgugccuuauccuacuuagcuucaugucuugaucaagugacuuccuuuggcgauauacuucaauuaguuauuguugaauuaauuuauaagguuugccaugcuaacccuucugaacguucucgauuuauacguugcauuuauaauuuacucaauucuaacaguccugcugugcgauaugaagcugcuggaacuuuaaucacacuuucgaaugcuccuacugcaauaaaagcugcugcuucuuguuacauugauuugauaauaaaggaaagugauaauaauguuaaauuaauuguauuagaucgucuuauaucuuuaaaagaaauuccuacucaugaacggguucuucaagauuuaguuauggauauauuacgugugcuagccaguccugacauggaaguaaagaaaaaagccuuaagccuagcacuggaucucacuacuucacgguguguugaagaaaugguuuuaauguuaaaaaaagaaguugcuaagacacauaacuugacagaacaugaagaugcuggaaaauaucgucaacuucuuguuagaacucuucauuccuguugcaugaaguuuccagauguugcugcuucaguuauaccaguauuaauggaauuucucucagauacaagugaacuagcuucguaugauguucuuauauuuguccgagaagcaauucauaaguuugauucuuuaaggguuuugaucauagagaaauuauuagaagcguuuccaaccauaaaaucuaugaaaguucaucgagcugcucuuuggauauugggugaauauacuacuucaguuacagauauuaaagaagucaugaaacaaauaaaacaugcccuuggagagauaccacuugucgaugaugaaauaaaaagagcuucuggagagaaaguugaggaaguugaucaucgagaucaaguaaaacugguuacaucugauggaacauaugcuacacaaucaauauuuaacaccauucuggcaauuaaaaaagaggaucgaccuccucucagacaauacuugauugauggagacuuuuuuuauugguguaucuguggcuucuacgcuugugaaauuagcauuacguuauaa

SEQ ID NO: 314 - RNA, 492 nt, Nevara viridula
augccuuuccagagguuuguugaaacuggaagaaucgcauacauugccgauggaccuuacaaaggcaaguugugugcuauuguggaugucauuaaccagaccagggcuuuaguugaugguccugaaacuggaguaccaagaugugguauaagauuaaaucaauuacaucuuacaaaauuuagaauucguuucccauauacugguucaacacguguuguacgaaaagcuuggaaagauagcaacuuagaugcuaaguggaaggaaaguguuugggccaaaaaguuagaagcaaaaaaaauaagagccaauaugaaugacuuugacagguuucgccuuaauaaugcuaggagaaccaggagcaaaaucaccaccaaugcauuuuugauucugaagaaacaagcuaaaaaggcuaaaaaaaccgaaguaaaaucuaaagacaagaaaccagaagcuaaaaagguuucugcuaagaaagcagaaaaaaagaaauaa

SEQ ID NO: 315 - RNA, 5043 nt, Nevara viridula
augucucaaauauuaccgauacgcuuccaagaacauuuacagcuuucgagcguaggaauaaacccaacuaguguaggcuuuaacacauuaacaauggagucugauaaguucauuuguguucgagaaaaaguuggagaaacuucucaaguugugauaauagauuuaaaugauacugcuaauccaauaagaagaccuauuucagcugauucagccaucaugaauccagcuaguaaaguaauagcacugaagggaaaagcugguccugauggaucaacuacucagaaaacacugcagauuuuuaauauugaaaugagaaguaagaugaaagcacacacaaugacagaugaaguaguuuuuuggaaauggauaucccuuaauacgcuugcuuuaguuacugaaacaucuguuuaucauuggagcauggaaggugauucacaaccaguaaaaauguucgauagacauucuagucugaaugguugucaaauuauuaauuacagaacagauccuaaacaaaccuggcuuuuauuaauuggaaucucugcucagcuaaaucguguaguuggggcuaugcaauuauauucaguagagcgcaaaugcucacagcccauugaaggccaugcugcaucauuugcccaguuuaaaauggaaggaaacccugauguaucuacuuuauuuugcuucgcuguucgaacacuucaaggaggaaagcuucacauaauugagguuggacagccuccuacaggaaaccaguccuucuccaaaaaagcaguugauguauuuuuuccaguagaagcccaaaaugauuuuccaguugcuaugcagguuagcucuaaguaugauguaaucuaucuuauaacaaaguauggauacauucauuuguaugauuuggaaacagcuaccuguauuuacaugaaccguauuaguauugauacuauauuugucacugcuccucaugaaucaacuggugguaucauuggugugaauagaaaaggccaggugcuaucagugagcguugaagaggaccacauaaucccauauaucaacaauauauuacaaaauccugaucuagcauuacgcauggcuguuagaaauaaccuagcuggagcugaagauuuguuuguuaaaaaauucaauaugcuuuuccaaaauggacaguaugcugaggcugcuaaaguggcugcaaaugcacccaagggaauucuccgaacuccucaaacaauucagcaguuccagcaaauaccaaauccacaaggucaaacauccccccuccuucaguauuucggaauuuugcuugaucagggucaauugaauaaguaugaauccuuggaauuaugcagaccuguuuuggcucaaggaagaaagcaauuauuggaaaaauggcugaaagaagacaaacuugaaugcucugaagagcuuggagauuuggugaaacaaacagauccaacucuugcucucucaguuuauuuaagagcuaauguucccaacaagguuauacaaugcuuugcugaaacuggacaauuucaaaaaauuguauuauaugcgaaaaaaguagguuauucgccagacuacauuuuccugcuccgaaauguaaugcguguuaauccugaucaagguguuagcuuugcucaaaugcuuguucaagaugaagaaccacuggcugauauaaaucagauuguugauauacuaauggagcaaaacaugguacagcagugcacagcauuccuuuuggaugcccuuaaaaauaaucggccuucugaaggcccauuacaaacuaggcuucuugaaaugaauuuaauuucugcuccucagguugcugaugcuauacuugggaaccaaauguuuacacacuaugauagagcccauauugcucagcuuugugagaaggcuggucuacuccaaagagcauuagaacauuauacagaucuuuaugauauaaaacgagcuguuguucacacucaucuucuuggcccugauuggcucguggguuauuuugguacccuuuccguugaagauucucuugagugucugaaagccauguuaacagcaaauauucgacagaauuuaaauauauguguucagauugcaacuaaguaccaugaacagcugacaaccaaggcuuugauagaucuuuuugaaucauucaaaaguuaugagggauuguuuuauuuccugggcucaauaguuaauuucagucaagaucaagaaguucauuuuaaauacauucaggcagcauguaaaacaggacaaauaaaagaaguugaacgaauuugccgugaaucuaauugcuauaauccagagagaguaaaaaauuuuuugaaggaagcaaaauugacagaucaauuaccacuuauuauuguuugugaucgauuugauuuuugucaugauuugguuuuauauuuauacagaaauaauuugcaaaaguauauugaaauuuauguacaaaaggucaauccuucucguuuaccuguuguaauaggaggauuauuagauguugauugcucugaagacauuauuaaaaauuugaugaugguuguuagaggucaguuuucaacugaggagcuuguugcagaaguagaaaagcggaauagauugaaacuuuugcuuccuugguuggaaacucguguucaugaaggcuguguugagccugcuacucauaaugcucuagcaaagauauauauugauaguaacaauaauccagaacgauucuuaagggaaaaucaguauuaugauagcuguguuguaggaaaguacugugaaaaacgagauccacauuuggcuuguguagccuacgaaagaggucaaugugauagagagcucauaaauguuuguaaugaaaauucccucuuuaaaucagaagccagguacuugguuagacguaaagauccugaauuaugggcugaaguucuuaaugaaaacaauccuuacaagagaccauuaaucgaucagguuguucagacugcucuuucagaaacucaagauccugaagauauuaguguuacugucaaggcuuuuaugacugcagauuuaccuaaugaacuuauugaacuucuagaaaaaauaguucuugauaauucaauauuuagugaccacaggaaucuacaaaaucuccucauucuuacugcuauaaaagcagaccgaucaagagucauggaauauauuaaucguuuagauaauuaugaugcuccugauauagcaaauauugcuaucaauuaucaauuauaugaagaagcauuugcaauauucaaaaaguuugauguuaacacuucugcuauccagguuuuaauugaaaaugugaacaaucuugauagagccuaugaauuugcugaacguuguaacgaaccagcuguguggagucaauuagccaaagcucaacugcaacauggccuugugaaagaagcaauugauucauucauaaaagcugaugacccuucugcuuauguugauguuguugagacagcucacaaaacagaaagcugggaggauuuaguucguuauuuacaaauggcaagaaaaaaggcuagagaaucuuauauugaaagugagcuaauuuaugcuuaugcucgcaccaaccgauuggcugaucuugaagaauuuaucucagguccaaaucaugcugauauucaaaagauuggugauagguguuuugaugauaagauguaugaaccugcuaaacugcuuuauaacaauguuucaaauuuugcuagacuagcuauuacauugguccaucuaaaagaauuucaaggagcuguggacagugcaagaaaagcaaacaguacaagaacuuggaaagaagucuguuuugcuuguguggauagugaagaauucagauuagcccaaaugugugguuugcacauugugguccaugcagaugaacuagaagaucugaucaauuauuaccaggaccgaggauauuuugaagagcuuauaaaucuguuagaagcagcacuuggguuagaacgugcucauaugggcauguucacagaauuagcuauucuguauucuaaauacaaaccagccaaaaugagggaacauuuagaauuauuuuggucucgaguuaacauuccaaaggucuugagagcugcugagcaagcucauuuaugggcagaguuaguuuucuuauacgauaaauaugaagaguaugacaaugcuguaucugcaaugaugaaccauccuacugaggcuuggagagaaggccauuuuaaagacauaauuacuaagguugcgaacauugaacuauauuacaaagcuauucaauuuuauuuggauuacaaaccucuccuuuuaaaugauauguuguugguauuagcuccaagaauggaccauacuagagcagugaauuucuuugcaaagguaaaccauuuacaguuggucaagccuuaucuucgcucaguacaaucauuaaacaauaaagcaauaaaugaagcucugaauaaucuuuuaauugaagaagaagacuuucaggguguuagaacaucaauugaugcuuuugauaauuuugauaauauuguauuagcucaaaagcuagaaaagcaugaguugauugaauuuagaaggauagcagcauaucuguauaaaggaaauaaccgauggaagcagaguguucaauuaugcaagaaggauagacuguucaaggaugcaauggaauaugcugcggaaucaaagaauucagaaguugcugaagaacuuuuagcaugguuuuuagaaaaaggaaaucaugacuguuuugcugcuuguuuguuccaauguuaugaucuucuucauccugauguuauucuggaacuugcauggcgacauaauaucauggauuuugcuaugccauauauuauucaagugacaagagaguauauuaccaagguugauaaauuagaagaauccgaagcaagaagguuagaagaaagagcagagcaagaucauaaaccuaugaugaugccggagccccaacuaauguuaacugcuggcccaggaaugauaggaccugguuuuucuccugcuuauccuaacacuuuuaccacuggcaugccuuaucaagguuauggcauguag

SEQ ID NO: 316 - RNA, 471 nt, Nevara viridula
augcagaucuucgugaaaacccucacggguaagacaauuacccuugagguugagccuucugauacuaucgaaaaugucaaagcuaaaauucaagauaaggaaggcauuccuccugaccagcagcguuugauuuuugcuggcaaacaguuagaagauggccguacucuuucugauuacaacauacaaaaggaaucuaccuugcacuuagugcuuaggcuuaggggaggugccaagaagcguaagaagaagaauuacuccacuccaaaaaaaaucaagcacaagaagaagaagguuaaacuagcugugcuuaaauauuauaagguugacgagaaugguaaaaucagcagguugaggagggaaugccccuccgagcagugcggugcuggcgucuucauggcugccauggaggacaggcacuacuguggaaagugugccuacacccuugucuucaauaagccagaagauaaauaa

SEQ ID NO: 317 - RNA, 582 nt, Nevara viridula
augguuaaccgaaggguuccaucugugcauaguaaaaccuauguuacuccaaggcguccuuaugaaaaggcccgucuugaucaggaauugaggauaaucggcgaguauggacugagaaauaaacgugaaguauggagggucaaauauacucuugcuaaaaucaggaaagcugccagagaauugcuuacucuugaugagaaggaucccaagagguuguuugaaggaaaugcacuuuugcgaagauuaguaaggauaggaguauuagaugaggcuaaaaugaaacuugauuauguuuugggucucaaaguugaagauuucuuggaaagaagacuucagacacagguuuuuaaacugggucuugcuaagucaauucaccaugcuagaguuuugauaagacaaaggcauauaagagugaggaagcagguugucaauauacccagcuucauugugagguuagacucacaaaaacacauugacuucucauugaaaucaccauucggugguggccgcccuggucguguaaagaggaagaauucucguaagggaacuacugcugcugcugcagaggaagaugaagauuaa

SEQ ID NO: 318 - RNA, 834 nt, Nevara viridula
auggcugguguuuuagcaacugagagaacucuuccuggcuuuucuuucgaaaauuguaaaaggaacuccacccuauugcaacaaggauuuaaaccuccuacugcccagaagacugguacaacuauuguuggaaucguauacagagaugguguuauccuuggagccgauacgagagcaacagaagguagcacaguugcugauaagaauugcuccaaaauacauuuccuugcugacaacaucuauugcuguggugcugguacugcugccgacacugaaaugaccacuaugacaauaaugucacaauuggaauuacaucgccuuaauacugggcgcccagucagaguuucuacugccaagcagcuuuugaaacaacuucucuucagguaucaggggcacauuggagcagcucuuguaguuggugguguugacguaaccggaccucuucuuuauucuauacauccucauggcuccucugagugcuuaccguuuacaacuaugggcucgggaucucuugcugcuaugacgguacucgaaucaucauggaagcccgauuugacggaagaagaagguaaaguaauuguccguaaugccauugcugcugguauauucaaugaccuugguucuggaagcaacguggacguuugcaucauccgcaaagguucuguugauuauauucgccccuuugauaucgcuaaucuaaaaggacagaagcaaaauaauuaucgcuuccgucgaggcacuacaggaguucuuucaacuagaauaaucccuuuggugacagaaucagaagaaauaaagaaaacugaaguagaaucgauggauacaucugcuuga

SEQ ID NO: 319 - RNA, 705 nt, Nevara viridula
auggguucugagagauauagcuuuucuuugacuacuuucaguccaucuggaaaauuaguucaaauugaguaugcacuugccgcagucgcagcuggagcuccaucaaucgguaucagagcauccaauggaguuguauuggcuacugaaaacaaauacaaaucaauuuuauaugaagaacauacuauucaaaaaguagaaaugauaacuaaacacauuggaauggucuacaguggaaugggaccugauuauaggcuacuagugaagagagcuagaaaaauggcucaacaauaucaguuaguuuacggugagccuauuccuacugcacagcuuguucaacgaguugccaugguuaugcaggaguacacucaaucuggagguguuagaccuuuuggaguuucuuuacucauugccgggugggauggggauaaaccaucucuguuucaaugugauccaucuggagcauacuuugccuggaaagcuacugcaaugggaaaaaauuuugucacuggcaaaacauuucuagaaaagagguacagugaaacuuuagagcuggaugaugcaguacauacugcaauucucacucuuaaagaaaacuuugaaggccaaaugacuucggacaauaucgaggucggaguuugugaugaucaaggguucagaguuuuagauccuacaacagugaaggauuaucuggcuaauauuccauaa

SEQ ID NO: 320 - RNA, 864 nt, Nevara viridula
auggcuccugcuaaaaaaccagcaccagccgcuaagaaggugccgacaaccacugucaccagugguaaggcuggcaaaaccgcugcagcuucuuccaaggcagcuccagcgccagcugcuaaagcagcugcagccaaaucagcagcucccacuucugcuaaaccaucagccaaacaacccgcuccagcuccuaaagccgcucagcccaaagcccaggcgaagccugccgcucaacaacaaaagccugcuaaaccacagcagcaaacaaaaacugcagcuccggcuaaaggucaagcuaagccugcagcccaggcaaagcccgcugcuccagcugcagcuccuaaacaacccgcagcuccagcugcagcaggaacucaaccugccgcagcagcacccaagaaagcuccuucaggugcaguuaaaaaagcaacaacugcgcccaaaaaaagucaaaauuuacagaagaagucccaccaagguguuaggaaacaaguguuaaaaggaaaaggacagaaaaagaaaaaaguaucauuaaaguuuauaauugacuguacucauccauaugaagacaaaauuauggacgucgccaacuucgaaaaguauauucaagaaagguuuaaaguuaaugguaaaaccaacaacuuaggcaauaauguuacuuuggaaaggaacaagaugaaaauaacuguuacuucagauguucauuucccuaagagguacuugaaauauuugacuaagagguaccuuaagaagaacaauuugagggauuggcucaggguuguaucuaguucgaaggauaccuaugaacuaagguacuuccaguuuaauagccaggaugaugaugaugaagaggacaaugauuaa

SEQ ID NO: 321 - RNA, 351 nt, Nevara viridula
augaccaagaaaaggaggaauggaggaagauccaaacaugguaggggucacgugcaagcaguccguugcaccaacugugcccguugcgugccaaaagauaaggcuaucaagaaauucguuauucguaauaucguagaagcugcagcugugagggauaucacagaugcuagcguuuacucuucguaccaguugccgaagcucuaugccaaacuacauuauugugugucaugugcuauccacucuaaaguagugcguaaucguucuaaggcugagagaagaauuaggacaccuccucagcguaacuucccaagggauaugaugcgucaagguggaccccagauaaggaaguaa

SEQ ID NO: 322 - RNA, 900 nt, Nevara viridula
auggguuucguuaaagucgugaaaaacaaacaauacuauaaaagguuucaaguuaaauucaagaggcgacaacuagguaaaacugacuauuaugccaggaaaagguugauuguucaagauaaaaauaaguacaauacaccaaaauaucguuuaaucguccguuuuuccaacaaagacaucacuugucagguugcuuauucacgcauugaaggugacaaaauauugugugcugcauacagccaugaacuuccucauuuuggaauuaaaguaggauuaacuaacuaugcugcugccuacugcacuggucuucuuuuggcuaggagguuacuucagaaauugaaguuggaugcacuauaugaagguacaacugaaguaacuggugaugaauacaauguagagaacuuggaugaaggcccaggagcuuuccguuguuauuuggauguugguuuaaugaagaccagugcuggagcccgaguuuuuggggcauugaaaggugcuguugauggaggucucaacaucccucacagcaugaaaagauuuccugguuaugauucugaaaguaaggaguucaaugcugaaguucaccgaaaacauauuuuuggaauucacguugcugauuacaugaggcaguuggccgaaucugaugaagaugcuuacaagaaacaguucagcauuuacaucaaaaaugggauuguuccugaugcuauugaagacauuuauaagaaggcacaugcagcaaucagagaaaauccugcucauagaccacaaguaaggacuaaggaagccaucaagaagagauggaaucgugcuaaacuuacccuugccgaaaggaagaauuguauugcccaaaagaaagcagcauuuuuaaaaaagaugaaggccggugauguugaugccuaa

SEQ ID NO: 323 - RNA, 1317 nt, Nevara viridula
ucagauaccauugaaaauguaaaagccaaaauucaagauaaggaaggaauuccgccagaucagcaaaggcugaucuuugcaggaaaacaguuagaagaugggcguacucuuucugauuacaacauccaaaaggaaucuacuuuacaucuuguacuuagacuucgaggaggcaugcaaauuuuugucaagacuuuaacagggaagaccaucaccuuagaaguugaaccaucugauacuauugagaacguaaaagcaaaaauccaggacaaagaaggaauuccaccagaccagcaacguuugaucuuugcuggaaaacaacuugaagauggccguacccuuucagauuauaauauucaaaaagagucuacucuucaucuuguacuucgcuugagagguggcaugcagauuuuuguuaagacgcuuacuggaaaaaccauaacuuuagaaguugaaccgucagauaccauugaaaauguaaaagccaaaauucaagauaaagaaggaauaccaccagaccaacagaggcuuauuuuugcuggaaagcagcuggaagauggccgaacuuugucugauuacaacauucaaaaggaaucaacacugcauuuggugcuucgucuaagaggaggcaugcagaucuuugugaagacuuugacagguaaaaccauuaccuuggaaguagagccaucugauacaauugagaauguaaaagcuaaaauucaggauaaagaaggaauuccuccagaucagcagcguuugaucuuugcuggaaaacaacucgaagauggccguacccuuucagauuauaauauccagaaggaaucuacucuacaucugguccuuagauugagagguggcaugcagaucuuugucaagacccuuacaggcaagacuaucaccuuagaaguugagccaucugacacuauugaaaauguuaaagccaaaauucaggacaaagagggaauuccuccugaccagcagcguuugaucuuugcuggaaaacaacuugaagauggccguacccuuucagauuauaauauucagaaggaaucuacucuucaucuaguacuucgauuaagagguggaaugcagaucuuugucaagacccucacggguaagacuaucaccuuggaaguugagccaucugacacuauugaaaaugucaaagccaaaauucaggacaaagaaggaauaccuccagaucagcagaggcuuauuuuugcuggaaaacaauuagaggauggucguacccuaucugauuauaacauccagaaggaaucaacucugcauuuaguguugcgucuuaggggcggauauuaa

SEQ ID NO: 324 - RNA, 594 nt, Nevara viridula
auggcggacgaugaggcgaagaaagcuaaacaggccgagaucgagcggaagagagcagagguccgaaagaggauggaggaggccucaagaggcaagaaggccaagaaagguuucaugacgccagacaggaagaagaaacuccgacuucugcugaggaagaaagcugcugaggaacugaaaaaagaacaagaaaggaaagcagcugagagaaggaggaucauugaggagcgcuguggaaagauaugugauguugacaaugccaaugaagagacccugaagaaaaucugccaagacuaucacaagcggauugaugcuuuggaacgcaguaaaauugacaucgaguuugaaguggagaggagggauuuugagauugcggaucuuaacagccaagucaaugaucuucguggaaaauucguaaagcccaccuuaaaaaagguuuccaaauacgaaaauaaauuugccaaacuucagaagaaggccgcugaauucaacuucagaaaucaacucaaaguuguaaagaagaaggaguuuacccuugaagaagaagacaaagagcccaagaagucugaaaaagcagaauggcagaagaaauga

SEQ ID NO: 325 - protein, 117 aa, Nezara viridula
MAPKAPKYEMAVGLKKGHRTTKIVMGKSKADKKHKIRPSRLKGRQTKHTKFVRDLIREVCGHAPYEKRGMELLKISKDKRALKFLKRRIGTHIRAKRKREELSNILTQMRKAHAQQK

SEQ ID NO: 326 - protein, 226 aa, Nezara viridula
MSLSDADVQKQIKHMMAFIEQEANEKAEEIDQKAEEEFNIEKGRLVQNQRLKIMEYYERKEKQVELQKKIQSSNMLNQARLKALKIREDHVRDVLDEARKRLLQSVKDEARYKDILEKLMLQGLYQLMESDILVRTREMDGPVVSSVFPDVLVKYKESSGKDLQLKLDTELYLPSECAGGIELYTARGRIKIVNTLESRLDLISAQLLPQIRTSLFGRNVNRKFTD

SEQ ID NO: 327 - protein, 118 aa, Nezara viridula
MASQTQGIQQLLAAEKRAAEKVAEAKKRKARRLKQAKEEAQEEIERYKQDREKQFREFEAQHMGSREDVAARIDADTRQKIEEMNEAVNANKEAVIQRILELVYDIRPEMHKNYRAPN

SEQ ID NO: 328 - protein, 430 aa, Nezara viridula
MSTSKTEEKPMWDERMEQALSEEIMRMSTDEIVSRIRLLDNEIKIMKSEVMRVSHELQAQTEKIKENTEKIKVNKTLPYLVSNVIELLDVDPEETEEDGAVVDLDARRKGKCAVIKTSTRQTYFLPVIGLVDAEKLKPGDLVGVNKDSYLILETLPAEYDARVKAMEVDERPTEQYSDIGGLDKQIQELIEAVVLPMTHKEKFENLGIHPPKGVLLYGPPGTGKTLLARACAAQTKSTFLKLAGPQLVQMFIGDGAKLVRDAFALAKEKSPAIIFIDELDAIGTKRFDSEKAGDREVQRTMLELLNQLDGFSSTADIKVIAATNRVDILDPALLRSGRLDRKIEFPHPNEDARARIMQIHSRKMNISVDVNFEELARSTDDFNGAQCKAVCVEAGMIALRRGAGVVTHEDFMDAILEVQAKKKANLNYYA

SEQ ID NO: 329 - protein, 128 aa, Nezara viridula
MQIFVKTLTGKTITLEVEPSDTIENVKAKIQDKEGIPPDQQRLIFAGKQLEDGRTLSDYNIQKESTLHLVLRLRGGVIEPTLKILAQKYNCDKMICRKCYARLHPRATNCRKKKCGHTNNIRPKKKLK

SEQ ID NO: 330 - protein, 395 aa, Nezara viridula
MTASQAMEPNREKALQDYRKKLLEHKEVEVRLKEMRDQLKDLTKQYDKSENDLKALQSVGQIVGEVLKQLTEEKFIVKATNGPRYVVGCRRQLDKLKLKSGTRVALDMTTLTIMRHLPREVDPLVYNMSHEDPGDVTYSAIGGLAEQIRELREVIELPLLNPELFQRVGITPPKGCLLYGPPGTGKTLLARAVASQLDANFLKVVSSAIVDKYIGESARLIREMFNYARDHQPCIIFMDEIDAIGGRRFSEGTSADREIQRTLMELLNQMDGFDSLGQVKMIMATNRPDTLDPALLRPGRLDRKIEIPLPNEQARLEILKIHAGPISKHGDIDYEAVVKLSDNFNGADLRNVCTEAGLFAIRAEREYVMQEDFMKAVRKVADNKKLESKLDYKPV

SEQ ID NO: 331 - protein, 416 aa, Nezara viridula
MAGAMLFERTVSSRDRDNSRILPTSSRNVDEENEEDIKNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVESPKALVALKYMLLSKIMLNTPEDVQQLVSGKLALKHAGKDIDAMKSVAQASHKRSLADFQLTLKNYKKELEEDPIVRAHLGTLYDNMLEQNLCRIIEPYSRAQVDFISKSIKLPLPQVEKKLSQMILDKKFNGILDQGEGVLIVFEDAIVEKTYEMALEVINSMGKVVDTLYQKAKKLS

SEQ ID NO: 332 - protein, 159 aa, Nezara viridula
MTNSKGYRRGTRDLFSRGYRKHGVIPLSTYMKVYKVGDIVSIKGNGAVQKGMPHKSYHGKTGRVYNVTPRALGVIVNKRVRGKILPKRINIRIEHVNHSKCREDFLKRVRENERLRKEAKEKGIHVELRRQPAQPRPAHLITVKEPPIMLAPIPYEFIA

SEQ ID NO: 333 - protein, 218 aa, Nezara viridula
EVPHWSPCCFLSVWNFGITMSSLKLQKRLAASVMRCGKKKVWLDPNEINEIANTNSRQNIRKLIKDGFIIKKPVAVHSRARVRKNTEARRKGRHCGFGTRKGTANARMPAKVLWVNRMRVLRRLLKKYREAKKIDRQMYHDLYMKAKGNVFKNKRVLMEFIHKKKAEKARSKMLRDQAEARRQKVKEAKKRREERITMKKQEILQSYQREDEAASAKK

SEQ ID NO: 334 - protein, 229 aa, Nezara viridula
IQSALREYRGSSSFTLPCFYKPSFAMGAYKYIQELYRKKQSDAMRYLLRIRVWQYRQMTKMHRVVKPSRPDKARRLGFKNKQGFCVFRIRIKRGGRKRPVPKGATYGKPKSHGVNQLKPTRSLHAMAEEKVGRKCSGLRVLNSYWVAQDARYKYYEVICVDPAHKAIRRDAKANWICDPVHKHREMRGKTSAARKSRGLGKGHRYSQTKGGSRKAAWVRRNTLQLRRKR

SEQ ID NO: 335 - protein, 376 aa, Nezara viridula
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMEACGIHETTYNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 336 - protein, 376 aa, Nezara viridula
MCDDDVAALVVDNGSGMCKAGFAGDDAPRAVFPSIVGRPRHQGVMVGMGQKDSYVGDEAQSKRGILTLKYPIEHGIITNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLYANTVLSGGTTMYPGIADRMQKEITALAPSTIKIKIIAPPERKYSVWIGGSILASLSTFQQMWISKQEYDESGPGIVHRKCF

SEQ ID NO: 337 - protein, 505 aa, Nezara viridula
MVLIAAAVCTKAGKTIVSRQFVEMTKARIEGLLAAFPKLMSSGKQHTFVETDSVRYVYQPLEKLYMVLITTKASNILEDLETLRLFSRVIPEYCRNMEESEITENAFNLIFAFDEIVALGYRESVNLAQIRTYVEMDSHEEKVYMAVRQSQEREAKNKMREKAKELQRQRLEAGKKGYKTPSIAGFGSSSTYTSPVVETIDLPKPTYTPAKPVLTAKAMKLGGKSRDVESFVDQLKSEGENVISQVAANKPVAAKLASTPNIHMEEVHLKQEEKLMVSVGKDGGIQSFELHGLVTLRITDEKYAKIKVYLDNKDKRGIQLQTHPNVDKELFKMKSQIGLKNPSKPFPLGTDVGVLKWRYQSQDESALPLTINCWPSENGQGGCDVNIEYELEHSHLELNDVTINIPLPIGCSPVVAECDGEYKHESRRNLLQWVLPVIDRSNKSGAMEFSTSSAIPSDFFPLTVSFTCKQPYADLKAVEVLHVDDETPVKFSSETLFYTERYEIV

SEQ ID NO: 338 - protein, 422 aa, Nezara viridula
MSVTSSDKRNEDWVGESKNGPSDKEHSYDGPPGMDPEGIIESNWDEVVDNFDDMNLKEELLRGIYAYGFEKPSAIQQRAIIPCVRGHDVIAQAQSGTGKTATFSISILQQIDTSARECQALILAPTRELAQQIQKVVIALGDFMGAMCHACIGGTNVREDMRKLEMGVHVLVGTPGRVLDMISRRALKTNTIRIFVLDEADEMLSRGFKDQIHDVFKNLNHEVQVILLSATMPSDVLEVSTCFMRNPIRILVKKEELTLEGIKQFFVFVEREEWKLDTLCDLYETLSITQAVIFCNTRRKVDWLTESMHNRDFTVSAMHGDMEQRERDIIMRQFRTGSSRVLITTDLLARGIDVQQVSLVINYDLPSNRENYIHRIGRGGRFGRKGVAINFVTEEDKRSLNDIEQFYNTRIEEMPMNVADLI

SEQ ID NO: 339 - protein, 263 aa, Nezara viridula
MARGPKKHLKRLNAPKSWMLDKLGGVFAPRPSSGPHKLRESLPLVIFLRNRLKYALTNTEVTKIVMQRLIKIDGKVRTDPNYPAGFMDVISIEKTGEFFRLIYDVKGRYAIHRITADEAKYKLCKVKRVQTGPKGIPYLVTHDARTIRYPDPLVKVHDTIQLDIATGKIIDIIRMESGNLCMITGGRNLGRVGTVVNRERHPGSFDIVHIKDASGHTFATRLNNVFIIGKGSKAYVSLPKGKGVKLSIAEERDKRLAAKGASS

SEQ ID NO: 340 - protein, 802 aa, Nezara viridula
MADMKSNEDLSTAILKKKDRPNRLIVEDAVNDDNSVVALSQAKMDELQLFRGDTVQLKGKRRKETVCIVLSDDTCPDEKIRMNRVVRNNLRVRLSDIVSIQACPEVKYGKRIHVLPIDDTVEGLTGNLFEVFLKPYFLEAYRPIHKDDTFVVRGGMRAVEFKVVETDPAPYCIVAPDTIIHCEGTHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEDQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKREKSRLDGATRMDMDDEDPVPEITREHFEEAMRFARRSVTDNDIRKYEMFAQTLQQSRGFGTNFRFPASSNIPSAPGGGGTETNNFPDDGDDDLYN

SEQ ID NO: 341 - protein, 134 aa, Nezara viridula
MTIEDESGPSGDSVDINTALKEVLKGVVRNGVIVHGLRESAKALDKRQALLCVLAENCDEPMYKKLVQALCSEHQIPLVKVDSNKKLGEWSGLCKIDKTGNPRKVVGCSCVVIKDWGDDTPHLDVLKDYMTESM

SEQ ID NO: 342 - protein, 149 aa, Nezara viridula
KKKKKKKYVVNSYYSSTTENTYSRRMSGRGKGGKAKGKAKTRSSRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKSS

SEQ ID NO: 343 - protein, 1534 aa, Nezara viridula
AVFRSSLAKRSQSSAPQNVKSHFCNINLTFFFLSTLKMDLRAVIVILVAASALPAYAQENGTNLLPRTKRNPTKLRHSRRFAERMPTSSYYDDYPPATNSQSQENHKPIFTNCSMYQPSVPEELTHTTTVIQVTAADKDPPESGGKVTYTFVATPQESQKFNIDPETGVITTRHSFDRDEPNREKEVYLTVRATDNGRPQLDDVCTFKVIIEDINDNAPVFDKVDYQESVPQDLPPKREVMRISATDVDDGNNSIVMYSLEPRSADMFNKTYFQIDSKTGVITLDRVIDRDPGYKFKLRATATDHGDIPKSAVINLDIQVVESNKKAPVFTSIPASPIVLLENFTDFTENIATLTAMSNDEKAPVFELVTGRTEQTNKYSTFRLESDANTAHIRLARRMDYESIAEYTLTIRIQNKFNLASETSINIQLEDVNDNIPAFTEVVSGVVLENEPAGTPVMQVRAIDADSTTAHNQVTYELADNKENFAIDRYTGNITTKKMFDREEQDFYNVKVIATDNSPSALYKTGVPNEGQQVFRIEIADKNDHPPKFTEAVYIAEAIPENANTNARVTQVNAQDNDTASLVHYSIFYGNENDAFVIDETTGEIRVNKNLDYETRTNYTLKVKAFDGAYEDNCEVHIKIENVNDNPPVFVSYQKTITIMEEELFPGCIAQLEAYDPDIPDRSAPQHILYFVVKQQQSMWLNINKKGCLSLIKPLDRDPPNGTESWQVLIGAKDEDGGPTGVQQTTEVIIMLTDINDNAPYLDMSQPVIWTENEPPGDIVKLNAEDNDGPENGPPFTFNIAPSASTEIQTKFTISGSTLKSLVRFDREERKSYFVPIAITDSGNPSLTGTSTLHVVIGDVNDNPMKSGYSEIFVYNYKGEAPDTEIGRVYVEDPDDWDLPDKRFEWAGMASPYFYLDPKTGMITMSQGTVDQSYVLNFTVFENTTRYFSAHSVSATVNVTVKEIPEEAVDKSGSVRLVGITAEEFIEANSNGISKRTMFRKYLAKFLNITEENVDVFTVLHSPHNTNTSLLDVRFSAHGSPYYSPEKLNAAVSVHNAELEKELGVAILMVNIDECLIERQYCEGSCINFLNKSREPIAVYTNTTTFVGVRAVVDPFCNCEVLSRPVCYNGGTLINDKCECEPGFEGPHCEILSVGFNGNGWALYPPLESCADSHLSLELRSNKKDGLVFYLGPTKPNRLLNVQDFISLEVVDGYPVLLLDFGTGTVKLDPKQIRLDDGEQHRIDIIWSRTTIELQVDNCKLPSCLSLKLKAGDNEFLNVNGPLQIGGSFVDFNYLDNHMNWTYKPARVGFSGCVKNVTFNNKLYNLGMPGHSKNADIGCNAGIAVAVSFGIDPSFIIAIIICLAILLILLLAVVVHRRKTDDLYKDTDDIRENIINYEDEGGGEGDMTAYDLNVLRLMYNDAMQDKPLPDHLNSRPDEVPDICGFLDGKKQSVDNDPETNPFDDVRHYAYEGDGNTTGSLSSLASGTDEGDLNFDYLSNFGPRFRKLADIYGKDSSDDDDDDDNYQTTASESWC

SEQ ID NO: 344 - protein, 369 aa, Nezara viridula
MSDEEYSESEEETVPEPEPQKKTEGDGDPEFVKRQEAKTSALDEQLKDYIAEWRKQRAKEEEDLKRLKEKQAKRKVMRAEEEKRLAEKKKQEEERRVREAEEKKQRDIEEKRRRLEEAEKKRQAMMAALKDQSKSKGPNFTISKKEAGLNLSSAQIERNKTKEQLEEEKRISLSIRIKPLSIENLNIDRLRLKAIELWDCIVKLETEKYDLEERQKRQDYDLKELKERQKQQLRHKALKKGLDPEALTGKYPPKIQVASKYERRVDTRSYDDKKKLFEGGWETLTAEELEKIWKSRYEQFTKRKHAKLPKWFGERPGKKKDAPESPEEEEVKPTDDDVEPVYAEEEEAEEEAEEEEEEEEEAEEEEEEE

SEQ ID NO: 345 - protein, 283 aa, Nezara viridula
MDAIKKKMQAMKLEKDNAMDRALLCEQQARDANLRAEKAEEEARSLQKKIQAIENDLDQTQEQLMQVLQKLEDKDKALQNAESEVAALNRRIQLLEEDLERSEERLATATAKLAEASQAADESERQRKVLENRSLADEERMDALENQLKEARFLAEEADKKYDEVARKLAMVEADLERAEERAESGESKIVELEEELRVVGNNLKSLEVSEEKANQREEEYKNQIKTLTNRLKEAEARAEFAERSVQKLQKEVDRLEDELVHEKEKYKYICDDLDQTFSELVG

SEQ ID NO: 346 - protein, 262 aa, Nezara viridula
MAVGKNKGLSKGGKKGVKKKVVDPFTRKDWYDVKAPSMFNTRQIGKTLVNRTQGTKIASEGLKGRVFEVSLADLQNDTDAERSFRKFRLIAEDVQGRNVLTNFHGMDLTTDKLRSMVKKWQTLIEANVDVRTTDGYLLRVFCIGFTNKDQMSQRKTCYAQHNQVRAIRKKMVDNITNNISNSDLRVVVNKLIPDSIAKDIEKICQGIYPLHDVYIRKVKVLKKPRFELSKLLELHGDGKGSDEPGSKVSRPEAYEPPVQESV

SEQ ID NO: 347 - protein, 220 aa, Nezara viridula
MGRRPARCYRYCKNKPYPKSRFCRGVPDPKIRIFDLGKKKARVDDFPLCVHLVSDEYEQLSSEALEAGRICANKYLVKNCGKDQFHIRMRLHPFHVIRINKMLSCAGADRLQTGMRGAFGKPQGTVARVHIGQPIMSVRSSDRYKAAVIEALRRAKFKFPGRQKIYVSKKWGFTKYDRETFEELRADGKLANDGCNVKYRRDHGPLSNWKKVQVELAAAS

SEQ ID NO: 348 - protein, 237 aa, Nezara viridula
MTCATPISKKKKFVADGVFRAELNEFLTRELAEEGYSGVEVRETPSRTEIIIMATRTQSVLGEKGRRIRELTSVVQKRFNFQPQSLDLYAEKVPTRGLCAIAQAESLRYKLIGGLAVRRACYGVLRFIMENGAKGCEVVVSGKLRGQRAKSMKFVDGLMIHSGDPCNEYVNSATRHVLLRQGVLGIKVKIMLPWDPTGKNGPKNPLPDNVCVVNPKDEIIPSDIKTMGIELHPPAII

SEQ ID NO: 349 - protein, 117 aa, Nezara viridula
MSKAELACVYSALILADDDVAVTGEKIQTILKAASVDIEPYWPGLFAKALEGINVKDLITNISSGVGVGGGAPAAAAGGAAPAAAAAPAGGDKKKEEKKKEESEPESDDDMGFGLFD

SEQ ID NO: 350 - protein, 218 aa, Nezara viridula
MSFLSKVFLGKKEEKAPTASEAIQKLRETEDMLIKKQDFLEKKIESELGLVKKNGTSNRRVAIQALKRKKRYEKQLQQIDGTLATIEMQREALEGANTNTAVLQTMKFAADALKTAHKHMDVDQVHDMMDEIAEQQDVAKEISEAISSPVAFGNDIDEEELEKELEELEQEELDRELLGTGPTADQLPDVPATQLPAKPKPIASEDDEELRQLQQWAT

SEQ ID NO: 351 - protein, 151 aa, Nezara viridula
MGRMHAPGKGISQSALPYRRSVPTWLKLSPEDVKEQIFKLGKKGLTPSQIGVILRDSHGVAQVRFVTGNKILRIMKAMGLAPDLPEDLYFLIKKAVAIRKHLERNRKDKDSKFRLILVESRIHRLARYYKTKGGLPPNWKYESSTASALVA

SEQ ID NO: 352 - protein, 427 aa, Nezara viridula
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFAPTRVWRRWHRKVNVNQKRYAMVSAIAATGVPALVMSKGHMVNEVPEIPLVVTDKIQEYTKTKQATIFLHRIKAWTDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSEEIKSVLKPPRKTIVRRVRKLNPLRNTRAMLKLNPFAAVLKRKAILADRKLKLERAIERSKKEGVELTPHQKRYVAMLERRKAQIKAAKAAKPKKVKKPKAEKAAADEAKKAAVTKKPAKKAAAPKPPKK

SEQ ID NO: 353 - protein, 204 aa, Nezara viridula
MTGFSDKPILIDGKGHLLGRLSAIVAKAALNGNRVVVVRTEQINISGNFFRSKLKYLSFLRKRCNVNPARGPFHFRAPSKILYRTIRGMVPHKIERGKAALRRIKLFEGIPPPYDKRKRVVVPTAMRVLCLKPGRAYCHLGRLSSEVGWKYKDVVRALETKRKVRAVFDIRKRNSLKKLTKQAKEKMSKANANYTAVINSYGYR

SEQ ID NO: 354 - protein, 1181 aa, Nezara viridula
MSPPGHLQGVVGCEVGSPAAWDKMSAAASGSSTKKRKKPENKPQSQINKCLNEKRRREQENIYIEELAELISASFTDMSSLSVKPDKCAILQETVLQIKTIKGGGSASDAVQQGEVSSSKPTILTNEVFGPLLLEALEGFLFVVNPEGKVEFCTENITQFIKYRREEVLGQPVYNIIHHGDHARFSSWLLPMSWSNDYHPPRPRTFNCRFLIKPPPDTTVEEKQQRPSKYENMQISSTQLPQSSGVDKDDDGSSESGPCLMCVARRIPPNEKPTGSPIEQFTMKLTTSGRIINVDNTGVSAPYSQYISKDLMNRNLEELVQSSDVPKVLSNIKEALTTGQSSTAIYKLLIAPAPENFLHVQTKFKLFKSANRQMENDFLMATHSIFGDIDININMGSPAGSSSQAIGGSNNTNQNQHQHQHQQQQQQQQQQQQSTSTSGVGGPLIASVNGANNRDLSNTITLNNSSAFHSVTLNSTDLDFNFDIFPSSSTWDLSSDERVWERPESRQSLTPVESPLYSNPPAQSPATTPFSTPYAFSPIQETTQEEPPEEDSGRLRNLLMTKRPSTESDDGGGGNIAQRNRHRILKNLLNQEDEESQPQDSKPPNNMLLKNQQSGDDGLLKSLGFRGETSEESRGGRKRPSSDESEDQPGPKRSSSSLLDAVPPPTPSAPSAASGKSRLWEKNQMLASLLAKRPTTPASIPPIPASVISATPQDKLQRLVKHPQTTGWSGGSVHTAAASPGHSRQGRSPGYNSAAHMWDSASSDPVLSDILDQVIEIVPDVNTDAPALMNMINSLEAETQQSVQQQFVSQTDLNEKMAISAIQKSLMLCESAVKGPSYQGTMSQGSPGPQPQPQQQPQPQQQPQPQQQQFHPPPMYQQRQRFPIQQQQQIRSQFPLSPMIMAQRSKMQQQQQMQQKQRLLHMQQQQQLVIPSNATASNNDPALHNIDSLINNTVAPNVSLQRSSSVPDSQLSPVGNYPGMGSVPSPGQRRPFSPVNGGMTNFSNSGGGGPSSGSGPQARLSPSSITGYQQQPQLSPRLSQGQQGYGGGGASWPQQNSRLSLQQQENPVLNAQLTSGGRGYARATTAGLPPVRSLAGPQRFPTGADQQASSSSYQFRLQRQVSAPQPQQSSPNAQLPGGNNGVTEYVRQELRAMVGARTSGSGRPQVPGSLPLPTPAVDLDS

SEQ ID NO: 355 - protein, 136 aa, Nezara viridula
MGKIMKSGKVVLVLSGRYAGRKAIVLKTCDEGTQEKAYGHAIIAGIDRYPRKVHKRMSKTKIHKRSKIKPFLKVMNYNHLMPTRYTVSEIAPDQKVVTKDLKDPMKKKKIRFQVRVKFEERYKQGKSKWFFEKLRF

SEQ ID NO: 356 - protein, 170 aa, Nezara viridula
TKNSMRELHIRKLCLNICVGESGDRLTRAAKVLEQLTGQQPVLSKARYTVRSFGIRRNEKIAVHCTVRGAKAEEILERGLKVREYELRRDNFSASGNFGFGIQEHIDLGIKYDPSIGIYGLDFYVVLGRPGFNVAHRRSKTGKVGFSHRLTKEDAMKWFQQKYDGIILNS

SEQ ID NO: 357 - protein, 1957 aa, Nezara viridula
MASKGPAGMQVGADDPDPTPYLFVSLEQKRIDQTKPYDAKKACWVPDEAEGFLQGEIQGTKGDIVSVKLPGGETKDFKKDLVGQVNPPKFEKCEDMSNLTYLNDASVLYNLKQRYYHKLIYTYSGLFCVAINPYKRFPVYTMRCAKLYRGKRRNEVPPHIFAISDGAYVNMLTNKENQSMLITGESGAGKTENTKKVIAYFATVGASTKKEEVSEKKGTLEDQVVQTNPVLEAFGNAKTVRNDNSSRFGKFIRIHFGPSGKLAGADIETYLLEKARVISQQTLERSYHIFYQIMSGAVKGVKELCLLSNDIYEYNYVSQGKISIAGVDDGEEMQLTDEAFNVLGFTQQEKDDIYKITAAVMHMGCMKFKQRGREEQAEADGVEEGIRVGKLLGVDGEELYKNLLKPRIKVGNEFVTQGRNVSQVTYSVGAMSKGMFDRLFKFLVKKCNETLDTKQKRQHFIGVLDIAGFEIFDFNGFEQLCINFTNEKLQQFFNHHMFVLEQEEYTREGIEWAFIDFGMDLAACIELIEKPMGILSILEEESMFPKATDKTFEDKLNTNHLGKSPNFQKPKPPKPGCQPAHFAIGHYAGVVSYNITGWLEKNKDPLNDTVVDQYKKGSNKLLCEIFADHPGQSGGATQDAGGKGGRGKKGGGFATVSSSYKEQLNNLMTTLRSTQPHFVRCIIPNELKQPGVIDSHLVMHQLTCNGVLEGIRICRKGFPNRMAYPDFKLRYKILNPAAVDKLTDEKAMAGVILESTGLDPDMYRLGHTKVFFRAGVLGQMEELRDERLSRIISWMQSYIRGYLCRKEFKKLQEQRLALQIVQRNLRRYLNLRTWNWWKMWSKVKPLLNVANVEEEMRKLEELVAQTQAALEKEEKARKEVEALNAKLLQEKTELLRNLEGEKGTLGSLQERSAKLQAQKADLESQLMDTQERLQQEEDARNQLFQQKKKLEQENGSLKKDIEDLELSVTKSDQDKASKEHQIRNLNDEIAHQDELINKLNKEKKIQSEHNQKTAEELQAAEDKINHLTKVKSKLEQTLDELEDSLEREKKLRGDVEKAKRKTEGDLKLTQEAVADLERNKKELEQTIQRKDKEMASLTAKLEDEQGIVNKTGKQIKELQSRIEELEEEVEAERQARGKAEKQRADLARELEELGERLEEAGGATSAQIELNKKREAEMSKLRRDLEEANIQHESTLANLRKKHNDAVSEMGDQIDQLNKLKTKVEKEKCQYLCELNDLRASIDHLTNEKAATEKIAKQLQHQLNEVQGKLDEANRSLNDFDSAKKKLSIENSDLLRQLEEAESQVSQLSKIKISLTTQLEDTKRLADEEARERATLLGKFRNLEHDLDNLREQVEEESEAKADIQRQLSKANAEAQLWRHKYESEGVARAEELEEAKRKLQARLAEAEETIESLNQKVIALEKTKQRLATEVEDLQLEVDRANAIANAAEKKAKAIDKIIGEWKLKVDDLAAELDASQKECRNYSTELFRLKGAYEEGQEQLEAVRRENKNLADEVKDLLDQIGEGGRNIHEIEKQRKRLEVEKDELQAALEEAEAALEQEENKVLRAQLELSQVRQEIDRRIQEKEEEFENTRKNHQRALDSMQASLEAEAKGKAEALRMKKKLEADINELEIALDHANKANAEAQKSIKKYQQQLKDVQTALEEEQRARDDAREQLGIAERRANALGNELEESRTLLEQADRGRRQAEQELTDAHEQINELAAQATSASAAKRKLEGELQTLHADLDELLNEAKNSEEKAKKAMVDAARLADELRAEQDHAQTQEKLRKALETQIKELQVRLDEAENNALKGGKKAIAKLEQRVRELENELDGEQRRHADAQKNLRKSERRIKELSFQSDEDRKNHERMQDLVDKLQQKIKTYKRQIEEAEEIAALNLAKFRKAQQELEEAEERADLAEQAVTKLRTKTGGRAGSTARAMSPVGQKQRRVPIDLE

SEQ ID NO: 358 - protein, 255 aa, Nezara viridula
MSSIGTGYDLSASQFSPDGRVFQVEYAQKAIENSGTVIGLRGKDGVVLAVEKLVTSKLYEPGANKRLFTIDKHIGMAVAGLISDARAVAEVARTEAANYRSQYKSSIPLKYLNERVSMYMHAYTLYSAVRPFGCSVILSTYTEEDGPEMYMIDPSGVSYGYFGCAVGKAKQAAKTEIEKLKLKDMSCQELVKEAARIIYLVHDELKDKQFELEMSWIGSQTSGVNQQVPANVHAEAEKDAKAAMEEDSDSETEDI

SEQ ID NO: 359 - protein, 267 aa, Nezara viridula
MVETSVVSPAAPAAGNKKASSTRKPQRRNYNLGSGVYRFSRTRMFHKKALWKFIGKKTPKTPRPKRKTTLEKKIGGEKNGGTRTVYLKKRTKSYPTTNKVRKHPSKTYFSQHKRRFRASLKPGAIVILLAGLHKGKRAVLLKNMASGLLLVSGPFSLNGVPLRRIHPNYVIASSTQIDLSGVKLPEHMNDRYFKRVKAKKAKKTDGEIFAAKKEIYKPSEQRKTDQKEVDKQILQAIKKHEHSLLLRKYLCTMFGLRSSQYPHRMKF

SEQ ID NO: 360 - protein, 243 aa, Nezara viridula
MSTKDKLPIFPSRGAQTLMKGRLVGAQKGHSLLKKKADALQIRFRMILSKIIETKTLMGEVMKEAAFSLAEAKFATGDFNQQVLQNVQKAQIKIRTKKDNVAGVTLPVFESYQDGTDSYELAGLARGGQQLAKLKKNYQKAIKLLVELASLQTSFVTLDEVIKLTNRRVNAIEHVIIPRIERTLQYIISELDELEREEFYRLKKIQDKKRIARQKAEAKKAVDAAAATMASNILEENDEDLLF

SEQ ID NO: 361 - protein, 221 aa, Nezara viridula
MAPRGNNMIPNGHFHKDWQRFIKTWFNQPARKYRRRIKRVKKARALAPRPATLLRPAVRCPTVRYHTKLRAGRGFTLEEIKRVGLCPGFARSIGIAVDHRRRNKSVESLQLNVQRLKEYQAKLILFPTKKSKKVKKGEASAEEQALATQVSSPVMPIKQTVVKYKARTITPEDKSFSAYGALRKARADVRLVGIRAKRLKEAADNPETVEKAAKQKKVKAK

SEQ ID NO: 362 - protein, 178 aa, Nezara viridula
MDGLLLEPTLYTVKGMVILDNDGHRILAKYYDPSVFPTSKEQKGFEKNLFNKTHRANAEIIMLDGLTCVYKSNVDLFFYVMGSSHENELILMSVLQCLYDSISQILRKNVEKRTLLENLEIVMLAMDEICDGGIILEADPTSVVQGVALRTDDIPLGEQTVAQVLQSAKEQIKSAILK

SEQ ID NO: 363 - protein, 182 aa, Nezara viridula
MGNMFANLFKGLFGKKEMRILMVGLDAAGKTTILYKLKLGEIVTTIPTIGFNVETVEYKNISFTVWDVGGQDKIRPLWRHYFQNTQGLIFVVDSNDRERIGEAREELMRMLAEDELRDAVLLIFANKQDLPNAMNAAEITDKLGLHSLRNRNWYIQATCATSGDGLYEGLDWLSNQLKNANR

SEQ ID NO: 364 - protein, 127 aa, Nezara viridula
MTDEVNPKAYPLADATLTAKILNVVQQALNYKQLRKGANESTKTLNRGLAEFIVMAADAEPLEILLHLPLLCEDKNVPYVFVRSKQALGRACGVSRPVVACSVTVNEGSQLKPQITKIQQDIERLLV

SEQ ID NO: 365 - protein, 433 aa, Nezara viridula
MPDYLGDDMRKTKEEKEEEKDIKSLDEADIALLKTYGQGQYTKSIKSVEDDIQTIIKRVNELTGIKESDTGLAPPALWDLAADKQILQNEQPLQVARCTKIINADSEDPKYIINVKQFAKFVVDLADSVAPTDIEEGMRVGVDRNKYQIQIPLPPKIDPTVTMMQVEEKPDVTYSDVGGCNEQIEKLREVVETPLLQPEKFVNLGIEPPKGVLLFGPPGTGKTLCARAVANRTDACFIRVIGSELVQKYVGEGARMVRELFEMARSKKACLIFFDEIDAIGGARFDDGAGGDNEVQRTMLELINQLDGFDPRGNIKVLMATNRPDTLDPALMRPGRLDRKVEFGLPDLEGRSHIFKIHARSMSVERDIRFELLARLCPNSTGAEIRSVCTEAGMFAIRARRKVATEKDFLEAVNKVIKSYAKFSATPRYMTYN

SEQ ID NO: 366 - protein, 147 aa, Nezara viridula
MKMNKLVTSSRRKNRKRHFTAPSHIRRKLMSSPLSKELRQKYNVRTMPVRKDDEVQVVRGHYKGQQVGKVIQVYRKKFVIYIERIQREKANGASVYVGIHPSKTVIVKLKIDKDRKEILDRRSRGRALALGKDKGKYTDENTAMDTS

SEQ ID NO: 367 - protein, 565 aa, Nezara viridula
MAVVEQPCYTLINFPSDLEPPNEMQLKSDLENGDTKAKIEALKNIIHLIANGERLPGLLMHIIRFVLPSQDHTIKKLLLIFWEIVPKTTPDGKLLQEMILVCDAYRKDLQHPNEFVRGSTLRFLCKLKEPELLEPLMPAIRACLEHRVSYVRRNAVLAIFTIYRNFEFLAPDAPELIANFLDGEQDMSCKRNAFLMLLHADQERALSYLASCLDQVTSFGDILQLVIVELIYKVCHANPSERSRFIRCIYNLLNSNSPAVRYEAAGTLITLSNAPTAIKAAASCYIDLIIKESDNNVKLIVLDRLISLKEIPTHERVLQDLVMDILRVLASPDMEVKKKALSLALDLTTSRCVEEMVLMLKKEVAKTHNLTEHEDAGKYRQLLVRTLHSCCMKFPDVAASVIPVLMEFLSDTSELASYDVLIFVREAIHKFDSLRVLIIEKLLEAFPTIKSMKVHRAALWILGEYTTSVTDIKEVMKQIKHALGEIPLVDDEIKRASGEKVEEVDHRDQVKLVTSDGTYATQSIFNTILAIKKEDRPPLRQYLIDGDFFYWCICGFYACEISITL

SEQ ID NO: 368 - protein, 163 aa, Nezara viridula
MPFQRFVETGRIAYIADGPYKGKLCAIVDVINQTRALVDGPETGVPRCGIRLNQLHLTKFRIRFPYTGSTRVVRKAWKDSNLDAKWKESVWAKKLEAKKIRANMNDFDRFRLNNARRTRSKITTNAFLILKKQAKKAKKTEVKSKDKKPEAKKVSAKKAEKKK

SEQ ID NO: 369 - protein, 1680 aa, Nezara viridula
MSQILPIRFQEHLQLSSVGINPTSVGFNTLTMESDKFICVREKVGETSQVVIIDLNDTANPIRRPISADSAIMNPASKVIALKGKAGPDGSTTQKTLQIFNIEMRSKMKAHTMTDEVVFWKWISLNTLALVTETSVYHWSMEGDSQPVKMFDRHSSLNGCQIINYRTDPKQTWLLLIGISAQLNRVVGAMQLYSVERKCSQPIEGHAASFAQFKMEGNPDVSTLFCFAVRTLQGGKLHIIEVGQPPTGNQSFSKKAVDVFFPVEAQNDFPVAMQVSSKYDVIYLITKYGYIHLYDLETATCIYMNRISIDTIFVTAPHESTGGIIGVNRKGQVLSVSVEEDHIIPYINNILQNPDLALRMAVRNNLAGAEDLFVKKFNMLFQNGQYAEAAKVAANAPKGILRTPQTIQQFQQIPNPQGQTSPLLQYFGILLDQGQLNKYESLELCRPVLAQGRKQLLEKWLKEDKLECSEELGDLVKQTDPTLALSVYLRANVPNKVIQCFAETGQFQKIVLYAKKVGYSPDYIFLLRNVMRVNPDQGVSFAQMLVQDEEPLADINQIVDILMEQNMVQQCTAFLLDALKNNRPSEGPLQTRLLEMNLISAPQVADAILGNQMFTHYDRAHIAQLCEKAGLLQRALEHYTDLYDIKRAVVHTHLLGPDWLVGYFGTLSVEDSLECLKAMLTANIRQNLNICVQIATKYHEQLTTKALIDLFESFKSYEGLFYFLGSIVNFSQDQEVHFKYIQAACKTGQIKEVERICRESNCYNPERVKNFLKEAKLTDQLPLIIVCDRFDFCHDLVLYLYRNNLQKYIEIYVQKVNPSRLPVVIGGLLDVDCSEDIIKNLMMVVRGQFSTEELVAEVEKRNRLKLLLPWLETRVHEGCVEPATHNALAKIYIDSNNNPERFLRENQYYDSCVVGKYCEKRDPHLACVAYERGQCDRELINVCNENSLFKSEARYLVRRKDPELWAEVLNENNPYKRPLIDQVVQTALSETQDPEDISVTVKAFMTADLPNELIELLEKIVLDNSIFSDHRNLQNLLILTAIKADRSRVMEYINRLDNYDAPDIANIAINYQLYEEAFAIFKKFDVNTSAIQVLIENVNNLDRAYEFAERCNEPAVWSQLAKAQLQHGLVKEAIDSFIKADDPSAYVDVVETAHKTESWEDLVRYLQMARKKARESYIESELIYAYARTNRLADLEEFISGPNHADIQKIGDRCFDDKMYEPAKLLYNNVSNFARLAITLVHLKEFQGAVDSARKANSTRTWKEVCFACVDSEEFRLAQMCGLHIVVHADELEDLINYYQDRGYFEELINLLEAALGLERAHMGMFTELAILYSKYKPAKMREHLELFWSRVNIPKVLRAAEQAHLWAELVFLYDKYEEYDNAVSAMMNHPTEAWREGHFKDIITKVANIELYYKAIQFYLDYKPLLLNDMLLVLAPRMDHTRAVNFFAKVNHLQLVKPYLRSVQSLNNKAINEALNNLLIEEEDFQGVRTSIDAFDNFDNIVLAQKLEKHELIEFRRIAAYLYKGNNRWKQSVQLCKKDRLFKDAMEYAAESKNSEVAEELLAWFLEKGNHDCFAACLFQCYDLLHPDVILELAWRHNIMDFAMPYIIQVTREYITKVDKLEESEARRLEERAEQDHKPMMMPEPQLMLTAGPGMIGPGFSPAYPNTFTTGMPYQGYGM

SEQ ID NO: 370 - protein, 156 aa, Nezara viridula
MQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKKKKVKLAVLKYYKVDENGKISRLRRECPSEQCGAGVFMAAMEDRHYCGKCAYTLVFNKPEDK

SEQ ID NO: 371 - protein, 193 aa, Nezara viridula
MVNRRVPSVHSKTYVTPRRPYEKARLDQELRIIGEYGLRNKREVWRVKYTLAKIRKAARELLTLDEKDPKRLFEGNALLRRLVRIGVLDEAKMKLDYVLGLKVEDFLERRLQTQVFKLGLAKSIHHARVLIRQRHIRVRKQVVNIPSFIVRLDSQKHIDFSLKSPFGGGRPGRVKRKNSRKGTTAAAAEEDED

SEQ ID NO: 372 - protein, 277 aa, Nezara viridula
MAGVLATERTLPGFSFENCKRNSTLLQQGFKPPTAQKTGTTIVGIVYRDGVILGADTRATEGSTVADKNCSKIHFLADNIYCCGAGTAADTEMTTMTIMSQLELHRLNTGRPVRVSTAKQLLKQLLFRYQGHIGAALVVGGVDVTGPLLYSIHPHGSSECLPFTTMGSGSLAAMTVLESSWKPDLTEEEGKVIVRNAIAAGIFNDLGSGSNVDVCIIRKGSVDYIRPFDIANLKGQKQNNYRFRRGTTGVLSTRIIPLVTESEEIKKTEVESMDTSA

SEQ ID NO: 373 - protein, 234 aa, Nezara viridula
MGSERYSFSLTTFSPSGKLVQIEYALAAVAAGAPSIGIRASNGVVLATENKYKSILYEEHTIQKVEMITKHIGMVYSGMGPDYRLLVKRARKMAQQYQLVYGEPIPTAQLVQRVAMVMQEYTQSGGVRPFGVSLLIAGWDGDKPSLFQCDPSGAYFAWKATAMGKNFVTGKTFLEKRYSETLELDDAVHTAILTLKENFEGQMTSDNIEVGVCDDQGFRVLDPTTVKDYLANIP

SEQ ID NO: 374 - protein, 287 aa, Nezara viridula
MAPAKKPAPAAKKVPTTTVTSGKAGKTAAASSKAAPAPAAKAAAAKSAAPTSAKPSAKQPAPAPKAAQPKAQAKPAAQQQKPAKPQQQTKTAAPAKGQAKPAAQAKPAAPAAAPKQPAAPAAAGTQPAAAAPKKAPSGAVKKATTAPKKSQNLQKKSHQGVRKQVLKGKGQKKKKVSLKFIIDCTHPYEDKIMDVANFEKYIQERFKVNGKTNNLGNNVTLERNKMKITVTSDVHFPKRYLKYLTKRYLKKNNLRDWLRVVSSSKDTYELRYFQFNSQDDDDEEDND

SEQ ID NO: 375 - protein, 116 aa, Nezara viridula
MTKKRRNGGRSKHGRGHVQAVRCTNCARCVPKDKAIKKFVIRNIVEAAAVRDITDASVYSSYQLPKLYAKLHYCVSCAIHSKVVRNRSKAERRIRTPPQRNFPRDMMRQGGPQIRK

SEQ ID NO: 376 - protein, 299 aa, Nezara viridula
MGFVKVVKNKQYYKRFQVKFKRRQLGKTDYYARKRLIVQDKNKYNTPKYRLIVRFSNKDITCQVAYSRIEGDKILCAAYSHELPHFGIKVGLTNYAAAYCTGLLLARRLLQKLKLDALYEGTTEVTGDEYNVENLDEGPGAFRCYLDVGLMKTSAGARVFGALKGAVDGGLNIPHSMKRFPGYDSESKEFNAEVHRKHIFGIHVADYMRQLAESDEDAYKKQFSIYIKNGIVPDAIEDIYKKAHAAIRENPAHRPQVRTKEAIKKRWNRAKLTLAERKNCIAQKKAAFLKKMKAGDVDA

SEQ ID NO: 377 - protein, 438 aa, Nezara viridula
SDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGY

SEQ ID NO: 378 - protein, 197 aa, Nezara viridula
MADDEAKKAKQAEIERKRAEVRKRMEEASRGKKAKKGFMTPDRKKKLRLLLRKKAAEELKKEQERKAAERRRIIEERCGKICDVDNANEETLKKICQDYHKRIDALERSKIDIEFEVERRDFEIADLNSQVNDLRGKFVKPTLKKVSKYENKFAKLQKKAAEFNFRNQLKVVKKKEFTLEEEDKEPKKSEKAEWQKK

SEQ ID NO: 379 - DNA, 354 bp, artificial sequence
  Nezara viridula
atggcgcccaaggctcccaaatatgaaatggccgttggccttaagaaaggtcacaggacaactaaaattgttatgggaaagtccaaagctgacaaaaaacataaaatcaggccatctcgtctaaaaggtagacaaaccaagcacactaaatttgtgcgagacttgatcagagaagtttgtggtcatgcaccttatgaaaagagaggaatggaattgctcaagatttctaaggataagagggctttgaaattcttgaagagaaggatcggcacacacatccgtgctaagaggaagagggaagaactcagcaacatccttacccagatgcgtaaggctcatgcccaacaaaaataa

SEQ ID NO: 380 - DNA, 681 bp, artificial sequence
  Nezara viridula
atgtctcttagcgacgcagatgtacaaaaacaaattaagcacatgatggccttcattgagcaggaggccaatgaaaaggctgaagaaatcgatcaaaaagctgaagaagaattcaatattgagaaaggtcggcttgttcagaatcaaagattaaagataatggaatattatgaaagaaaagaaaaacaggtcgaactacaaaagaaaatccaatcttcaaatatgttgaaccaagctcgactgaaagctttgaaaattcgtgaagatcatgtgcgtgatgtgctcgatgaggccaggaagagactcttgcaatcagtcaaagatgaggctcgttacaaagacattcttcagaaacttatgcttcagggactgttccagttgatggaatcagacattttggttagaactcgtgaaacggatggcccagttgtcagctcagtgtttcctgatgtgctggtcaaatacaaggaagcatcaggtaaggatttgcaacttaagttggatacagagtcgtacttaccatctgaatgtgctggcggtattgaactatacactgctagagggcgtatcaagattgttaatactcttgaatccaggctcgatcttatttcagcccagttattgccccagatcagaacatctctattcggtcgcaatgcaaaccgtaaattcgctgactaa

SEQ ID NO: 381 - DNA, 357 bp, artificial sequence
  Nezara viridula
atggccagtcagactcaaggaattcagcagttattggcggctgagaaaagagctgcagaaaaagttgctgaggcgaaaaaacgcaaggcaaggcgcctcaagcaagctaaagaagaggcccaagaagaaattgagaggtacaagcaagatagagaaaaacagttcagagaatttgaagctcagcatatgggatctcgagaagacgttgcagcaaggatagatgctgatacccgccaaaagattgaggaaatgaatgaagcagtaaatgccaacaaagaagcggttattcaaagaattttggaattggtttatgatatcagacctgagatgcataagaactacagagcaccaaattaa

SEQ ID NO: 382 - DNA, 1293 bp, artificial sequence
  Nezara viridula
atgtctacatcaaaaacagaagaaaaacctatgtgggatgaaaggatggaacaagcattaggtgaagaaattatgagaatgtctactgatgaaattgtaagccgtattagacttcttgacaatgaaatcaaaatcatgaaaagcgaagttatgcgagtgagtcatgagttgcaagcacaaacagaaaaaataaaagaaaacacagaaaaaattaaagttaataaaaccttaccatacttggtttcaaatgtgatcgagttgcttgacgtagatccagaggagactgaagaagatggtgctgttgtagaccttgatgctcggcgtaaaggaaaatgtgccgtcataaaaacatcaaccagacaaacttattttttgccagtcattggcttagttgatgcagaaaaattaaagccaggtgaccttgttggagtgaataaagattcttatttgattcttgaaactttgcctgcagaatatgatgcaagagtcaaagctatggaagttgatgaaagacccactgaacagtattctgatattggtggactagacaagcagattcaagaactaatcgaagctgttgttcttcctatgacccacaaagaaaagtttgaaaatcttggaattcatcctcctaaaggtgtactactttatggacctcctggaacaggaaaaacattattggccagggcgtgtgcagctcaaacaaaatcaacttttttgaaactagctggtcctcagcttgtacaaatgttcattggggatggagctaaacttgttagagatgcctttgctcttgctaaggaaaaatctccagcaattatatttattgatgaattagatgctattgggactaagagatttgattccgaaaaggctggagatcgagaagttcaaagaactatgttagagttactcaaccagttagatggctttagctcaactgctgacataaaggttattgctgcaacaaacagagtagatattttagatcctgcccttttgcgttcaggaagactggatagaaaaatcgaattccctcaccctaacgaagatgccagagcacgtataatgcaaattcattcccgtaaaatgaacattagtgttgatgttaattttgaagaacttgctcgttcaacagatgatttcaatggtgctcagtgtaaagctgtttgtgtagaagcaggtatgatagctttgcgtagaggagctggagtagttactcatgaagattttatggatgcaatattagaagttcaagcaaagaaaaaagctaacttaaactactatgcttag

SEQ ID NO: 383 - DNA, 387 bp, artificial sequence
  Nezara viridula
atgcagatcttcgttaaaacccttacgggtaaaaccattaccctagaggttgaaccttctgatactatcgaaaatgtaaaagctaaaattcaagacaaagaaggaattcctccagatcaacaaaggcttatttttgctggcaaacagttggaagatggaagaacattatctgattacaacattcagaaagaatctactcttcacttggtgcttcgtcttaggggtggtgtcattgaaccaactctgaagatccttgcccagaaatacaattgtgataaaatgatttgccgcaagtgctatgctagacttcacccaagagcaactaactgccgcaagaagaaatgtggtcataccaacaacatccgccccaagaagaagctgaagtag

SEQ ID NO: 384 - DNA, 1188 bp, artificial sequence
  Nezara viridula
atgacggcttctcaagcaatggaaccaaacagagaaaaagctttacaagattatcgtaaaaaattactagagcataaggaagtagaagttagacttaaagaaatgagagaccagttaaaagatcttactaaacagtatgataaatctgaaaatgatttaaaagccctccaaagtgttggccagattgtcggagaagttttgaagcagcttactgaagaaaaatttattgtaaaggctacaaacggcccaagatacgttgttggttgtaggcgacaactggataagttgaaactgaaatctggtactcgagtagcattggatatgacaacactaactataatgagacacttacccagggaagttgatccattagtgtataacatgtctcatgaagacccaggagatgtcacatattctgctattggaggtcttgcggaacaaattagggaacttcgtgaggtgatcgagctgcctctattgaatccagaactttttcaacgtgttgggatcactccccccaaaggatgtctactttatgggcctcctggtactggaaagactttattggctagagctgttgccagccaattagatgctaatttcctgaaggttgtttccagtgccattgttgacaagtatattggtgaaagtgctcgtctgatcagagaaatgtttaattatgcaagggatcatcagccttgcataatttttatggatgaaattgatgctattggtggtcgaagattctcagaaggtacatctgctgatcgtgaaattcaaagaacccttatggaacttcttaaccaaatggatggatttgattcattaggacaggtaaaaatgatcatggccactaatcggcccgacacccttgacccagctctcctccgtcccggtaggttagacaggaagattgaaataccactgccaaatgaacaggccaggctagagatcctcaagatccacgctagtcctatttcgaagcatggagatattgattacgaggctgttgtgaagttgtctgataatttcaatggagctgatttgagaaatgtttgtactgaagctggtctttttgctattcgagctgaaagggaatatgtaatgcaggaagattttatgaaagccgtgaggaaagtggctgacaacaagaaactggagtcaaaacttgattacaagccagtataa

SEQ ID NO: 385 - DNA, 1254 bp, artificial sequence
  Nezara viridula
atggcgggtgcaatgttgtttgagaggactgtctcttctagagatagggataatagtcgaattcttcctacttctagcagaaatgtcgacgatgacaatgacgaagaagacatcagaaataaggaacaagggattttgcagttgggagagcaatacaagaaagagggtaaagctaaagagttagcagaacttatcaaggcaagtagaccctttcttagtcaaataagcaaagctaaagctgcgaaattggtgcgttctttagtggattatttcttggatcttgaagctgggataggaatagaagttcaactttgtaaagagtgtatagaatgggcaaaagatgaacacaggactttcctcaggcagtcactggaagccaggcttattgctctatatttcgacactggaatgttcacagaagcactccagctcggctcaagtctccttaaggaattgaagaagttagatgataaaaatttgcttgttgaagttcttttgttggaatccaaaacttatcatgctttgagtaatctttctaaagcccgggctgctctgacatcggccaggacaactgctaattcaatttattgtccacctaaaatgcaagcagccctcgatttgcagtctggtatattacacgcagctgacgaacaggatttcaaaacagcttactcatacttttatgaagcatttgaaggttatgatagtgttgacagcccgaaggctttggtagctcttaagtacatgcttttgagtaaaatcatgttgaatacgccagaagatgtgcagcaactagttagtggaaaacttgctcttaaacacgctggtaaagatatcgatgcaatgaaatcagttgctcaagctagccataagagatcccttgccgattttcagataactttaaagaattacaagaaagagctggaagaggatccgatcgtaagagctcacttgggtacactttacgacaacatgttggaacagaatttgtgtaggatcattgagccgtattcaagagttcaggtcgattttatttcaaaatcgatcaagcttccccttcctcaagtcgaaaagaagctttctcagatgattcttgacaagaagttcaacggaattctcgaccaaggtgaaggagttctaatagtgtttgaagatgcagtcgttgaaaaaacctacgaaatggctttagaagtcattaacagtatgggtaaggtcgtagacacattatatcaaaaagctaagaagctctcataa

SEQ ID NO: 386 - DNA, 480 bp, artificial sequence
  Nezara viridula
atgacgaactccaagggttatcggcgaggtacccgtgacttgttttcacgtggataccggaaacatggtgtcattccactttcgacttacatgaaagtctataaagttggagacatcgtatcaattaagggtaatggagccgttcaaaaaggtatgccccacaaaagttatcatggcaaaacaggacgagtttacaatgttactcccagagctttgggtgtgatcgtcaacaaaagggtccgtggaaaaattctacccaagaggatcaacatccgtattgagcacgtcaaccactccaaatgccgtgaagatttcttgaagcgtgtccgagaaaatgaaaggctgaggaaggaggccaaagaaaagggtattcgagttgaattgaaaagacagcctgcccagccacgacctgctcatttgataactgtcaaggagcctccaatcatgcttgctcccataccttatgaatttattgcttaa

SEQ ID NO: 387 - DNA, 600 bp, artificial sequence
  Nezara viridula
atgagttcattgaagctacagaagaggctagcagcctctgttatgaggtgtggtaaaaaaaaggtttggttagatcctaatgaaattaatgaaatcgccaacaccaactcaagacaaaacatcaggaagttaataaaagatggttttatcatcaagaaacctgttgcagtacattctagagcccgtgtccgtaaaaatactgaagccagaaggaaaggtaggcattgtggctttggtaaaaggaaaggtactgctaatgcaagaatgccagcaaaggttttgtgggtgaacagaatgagggttcttaggcggttattaaagaagtatagggaagccaaaaaaattgacaggcagatgtatcatgacttatacatgaaagctaaaggtaacgttttcaaaaacaagcgtgtacttatggaattcattcacaagaagaaggctgaaaaagctaggtctaagatgcttcgtgatcaagctgaagccaggaggcagaaggttaaagaagctaagaagcgacgagaagaaaggatcacattaaagaaacaagaaattttacaatcctaccagagggaagatgaagctgccactgctaaaaaataa

SEQ ID NO: 388 - DNA, 786 bp, artificial sequence
  Nezara viridula
atggtgatgaatttgtttatagcgacgggccatatgggcttgtttcgtcggttgcttatcagctgttcacagccttcattatcggaagcagcgccgatacagccagccttggcaaagtatccagaaagctcttcgctcacgttaccgtgtttcccaaagccttcatttacaatgggggcttacaagtacattcaggaactgtacagaaaaaagcagtcagatgccatgcggtatctgctgcgtatcagggtttggcaataccgacagatgaccaagatgcaccgcgtcgtgaagccatcaaggccagacaaagccagaagattgggatttaagaataagcaaggtttctgcatcttcaggatccgtatcaagaggggaggtaggaaacgcccagtcccaaagggtgccacctacggcaaacctaaaagccatggagtcaaccagctcaagcctacaaggagtcttcacgccatggctgaggagaaagttggtaggaggtgcagcggattgagggtactcaactcctattgggtcgcccaagacgctaggtacaagtactatgaggtcatctgcattgacccggctcacaaggctatcagaagagacgctaaggccaactggatatgcgacccagtgcacaagcaccgtgagatgcgcggcaagaccagcgccgccaggaagtctcgaggcttgggcaagggccacaggtactctcagactaagggaggttccaggaaggctgcctgggtgagaaggaacacactccagctgaggagaaagcgataa

SEQ ID NO: 389 - DNA, 1131 bp, artificial sequence
  Nezara viridula
atgtgtgacgacgatgttgctgccctcgtagttgacaatggttccgggatgtgcaaggccggcttcgccggagacgacgccccgagggccgtcttcccctccatcgtcggcagacccaggcaccagggtgtcatggtcggtatgggccaaaaggacagctacgtaggagatgaagcccaaagcaagagaggtatcctgaccctgaagtaccccattgaacacggtatcatcaccaactgggacgacatggaaaagatctggcatcacaccttctacaacgagctgcgagtcgctccagaggaacaccccatcctcctcactgaggctcccctcaaccccaaagctaacagggagaagatgacccagatcatgtttgagaccttcaacaccccagccatgtatgtcgccatccaggctgtactctccctctacgcctccggtcgtaccaccggtattgtacttgactcaggagatggtgtctcccacaccgtacccatctatgaaggttatgcccttccccacgccatcctccgtctggatcttgctggacgtgacttgactgactatcttatgaagatcctcaccgagcgtggttacagcttcactaccaccgctgaaagggaaattgtcagggacatcaaggaaaaactgtgctatgtcgccctggactttgagcaggaaatggccaccgctgccgcctccacctccctcgagaagtcctatgaacttcccgacggtcaggtcatcaccatcggtaacgagaggttccgttgcccagaggctctcttccagccttccttcttgggtatggaatcttgcggtatccatgagactgtctacaactccatcatgaagtgcgatgttgacatcaggaaggacctgtacgccaacactgtcctttccggaggtaccaccatgtacccaggtattgctgacaggatgcagaaggaaatcaccgccctcgctccttcaaccatcaagatcaagatcatcgctcccccagaaaggaagtactccgtatggatcggaggttccatcttggcctccctgtccaccttccagcagatgtggatctccaagcaggaatacgacgaatccggcccaggcatcgtccaccgcaaatgcttctaa

SEQ ID NO: 390 - DNA, 1518 bp, artificial sequence
  Nezara viridula
atggtgctaatcgcagcagcggtttgcacaaaagctggtaaaacaatcgtttcgaggcagtttgtcgaaatgactaaggcccgcatcgaaggattgttagcagcatttccaaagttgatgtcatcgggtaaacaacatacatttgttgaaactgattcagttcggtatgtatatcagcccctggagaaactttacatggtgctgataactactaaggcctcaaatattttagaagatcttgaaacactaagactgttctcccgtgtaattcctgaatattgccgcaatatggaagagtcagaaattactgaaaatgcgtttaatttgatcttcgcatttgatgaaattgtggctcttggttacagggaaagtgttaacttagctcagattaggacttatgtcgaaatggattctcatgaagaaaaagtatacatggctgtaagacagtcgcaagagagagaagccaaaaataaaatgagggaaaaagccaaagagctgcagagacaaaggttagaagccggtaagaaaggctacaaaactccaagtattgctggatttggttcatcatcaacatacacaagtccagttgttgaaactgtcgatctgcctaaaccttcatatacacctgcgaaacctgtcttatcagcaaaagctatgaaacttggtggtaaatcaagagatgttgaatcatttgttgatcaactgaaatctgagggagaaaatgttatctcacaagtagctgtaaataagcctgttgcggccaagttagcttcttcgccaaatattcacatggaagaggtccatctgaagcaggaagaaaagctgatggtttctgttggaaaggatggtggaatacagagcttcgagctccatggccttgtaactttacggataactgatgaaaaatatgcaaagataaaagtatatcttgacaataaagataagagaggaattcagttgcagacacatcctaatgtggataaagaattgttcaaactgaaatctcagataggtttgaagaatccttcaaaaccatttcccttaggaactgatgtaggtgtacttaaatggcggtaccaatctcaagatgaatctgcacttcctcttactattaattgttggccatcagaaaatggacaaggagggtgtgatgtcaatattgagtatgaacttgaacatgctcatcttgaactaaatgatgttaccatcaacattccattacctattgggtgctctcccgttgttgctgagtgtgatggtgagtacaagcatgagtcccgaaggaacttgctccagtgggttctgccagttatagacaggagtaacaaatcgggagcgatggagttttcggcatcttcagccatgccttctgactttttccctttgatagtatcgttcacctcaaaacagccctatgcagatctaaaggctgttgaagttcttcatgttgatgatgaaactcctgtaaagttttcaagtgaaacattgttttatacagaaaggtatgaaattgtataa

SEQ ID NO: 391 - DNA, 1188 bp, artificial sequence
  Nezara viridula
tatgatggtccaccagggatggaccctgaaggaatcatcgagtccaattgggatgaggttgttgacaattttgatgatatgaacctcaaagaagaacttctcagaggaatttatgcttatggttttgaaaaaccttctgctattcagcaacgggcaattataccgtgtgttagaggacatgatgttattgcccaagcacagtcaggtactggtaagacagctacattctccatttctatattacaacaaattgacactagtgcaagagaatgccaggctttgatattagccccaacacgtgaattagctcaacagattcagaaagtagttatagccttgggagatttcatgggagccatgtgccatgcatgcattggtggtacaaatgtgagagaagacatgcgtaaattagaaatgggagtgcatgttttagttggaactccaggacgagttttggatatgattagccgcagggctctaaaaacaaatactattagaatttttgtgttggatgaagctgatgagatgctttctcgtggtttcaaagatcagatccatgatgtatttaaaaatttgaatcatgaagtacaggttatattgctttcagctactatgccatcagatgtattggatgtcagtacatgcttcatgaggaatcctattcgtatcttagttaaaaaggaagaacttaccttggaaggtatcaaacagttttttgtatttgttgagagggaagagtggaagttggatactctttgtgatttgtatgaaactctaagtattacccaagctgtaattttctgtaatacaaggcgtaaggtcgattggctgactgagaacatgcataatagagacttcactgtttctgctatgcatggagatatggagcaaagagagcgagatataattatgcggcagttccgtactggttccagcagagttttgatcactactgaccttttggctagaggcattgatgtgcagcaagtttctcttgtcatcaattatgatcttccatcaaatagagaaaattatattcacaggattggaagaggtggccgattcggtcgtaaaggtgtggcgattaactttgtaacagaagaggacaaacgctctcttaatgatattgaacagttctacaatacccgtatcgaagaaatgcctatgaatgttgccgacctcatttaa

SEQ ID NO: 392 - DNA, 792 bp, artificial sequence
  Nezara viridula
atggctcgtggtcccaaaaaacatttgaagcgtttaaatgctcctaagtcatggatgttggacaagcttggtggtgtttttgcccccagacccagctctggtccacacaaactgagggaatccttgcccttagtcattttccttcgtaacagactaaagtatgctctgaccaatactgaagtgacaaaaattgtaatgcaaaggttgatcaaaattgatggtaaagttaggacagaccctaactatcctgctggtttcatggatgtgatcagcattgagaaaactggtgaatttttccggttaatttatgacgttaaaggacgttatgccattcataggattactggtgatgaagccaagtacaagctgtgtaaagttaaaagagtgcagactggacctaagggtataccttatttagtgacacacgacgctagaaccatcaggtacccagatccacttgtcaaagtccatgacaccattcagcttgatattgccactggcaaaatcattgatatcatccgaatggagtcaggtaatctttgcatgattactggtggccgtaacttgggaagagtaggaactgtagtgaacagggagagacatcctggttcttttgatattgtccatattaaggatgctagtggacatacctttgccacacgattgaacaatgtgttcattattggaaagggcagcaaagcatacgtttcattacctaagggcaagggtgtgaagctcagtattgctgaagaaagagataagaggcttgccgcaaagggtgcatccagctaa

SEQ ID NO: 393 - DNA, 2409 bp, artificial sequence
  Nezara viridula
atggctgatatgaaaagcaatgaagatttgtcaactgcaatcctgaaaaagaaagatagaccaaacagattgattgtggaagatgcagtcaatgatgacaattctgttgttgctctctcacaggccaaaatggatgaacttcagttatttcgtggagatactgtgcagcttaaagggaaaagaaggaaggaaactgtttgtatagttttatctgatgatacatgccctgatgaaaaaattaggatgaacagagttgtacgaaataatttacgagttcgtttgtcagatattgtttcaattcaagcttgtcctgaagtaaaatatggcaaaagaatacatgttttacctatagatgacactgttgagggattgactgggaatttgtttgaagtgttccttaaaccatattttctggaagcataccgtcctattcataaagatgatacttttgttgttagaggtggtatgcgtgctgtagaatttaaggtagtagaaacagatcccgctccttactgtattgtagcacctgatactatcattcattgtgagggtaatcatataaagagagaggaagaagaagaagctttaaatgctgttggatatgatgatattggaggttgtagaaagcaacttgctcagattaaagaaatggttgagctacctttgagacatcctagcttattcaaagcaattggtgttaaacctcctcgtggaatattactttatggaccacctggaactggtaaaacattaatagcacgtgctgtggctaacgaaacaggagcattcttctttttaatcaatggccccgaaattatgagtaaattagctggtgaatctgaaagtaatctgcgtaaagcatttgaacaagctgaaaaacatgctccttccatcatttttatcgatgagttagatgccattgctccaaaacgagacaagactcacggagaagtggaaagaagaatcgtctcacaattacttacattaatggatggtcttaaacaaaattctcatataattgtcatggctgctaccaacaggcctaattcaattgatgctgctcttagacgttttggacgatttgatcgtgaaattgatattggtattccagatacaactggacgtttagaggttcttcgaattcatacaaaaaatatgaaactagctgatgatgtcaatttagaacagattgctgctgaaacacatggtcatgttggagcagatttggcatctctctgttcagaagcagcacttcagcagatccgtgaaaaaatggatctaattgatttagaagaagagcaaattgatgcagaagttctaaactccttggctgttactatggataacttccggtatgctatgggcaaaagtagcccaagtgcccttcgtgaaactgtggttgaagttccaaatattacttgggatgatattggtggtctggataatgttaaaaaggaattgcaagaattggttcagtaccctgttgaacatccagaaaaattcttgaaatttggaatgcaaccttcccgtggtgttttattttatggaccaccaggttgtggtaagacattgttagctaaagctattgctaatgaatgtcaggcaaacttcatttcagtcaaggggccagaattattaactatgtggtttggagaatcagaagctaatgttcgtgatatttttgataaggctagagctgctgcaccatgtgttctattttttgatgaactggattccattgctaaatcaagaggtggaagtgttggagatgctggaggtgcagctgatagagttatcaaccaaatccttactgaaatggatggaatgggagccaagaaaaatgtttttataattggggctactaatagaccagacataattgatcctgctattctgagacctggccgtttagatcaactcatttatataccattacctgatgagaagtcaagagaagccatcttcagagcgaacttaagaaaatcacctgttgccaaggatgttgatttacaatatattgccaaagttacatttggttattctggagctgatcttactgaggtatgtcaaagagcgtgtaaacttgcgatcagacagtccattgaagctgaaatcaaaagggaaaaaagtagattagatggagctacacgaatggatatggatgatgaggatcctgtccctgaaataacacgtgaacattttgaagaggcaatgaggtttgccaggcgttctgtcactgataatgatattcgcaagtatgaaatgtttgctcagacattacaacaatcaagaggttttggaactaattttagattccctgctagctcaaatattcctagtgcaccaggaggtgggggaactgaaactaacaactttccagatgatggagatgatgacctttataattaa

SEQ ID NO: 394 - DNA, 402 bp, artificial sequence
  Nezara viridula
atgaccatcgaagacgaatctggcccatctggcgactccgttgatatcaacaccgcattaaaagaagttttgaaaggagtagtgaggaatggaataattgttcatggtctgagggagtcagctaaagctcttgacaagcgacaggctttactctgcgtcctggccgaaaactgcgacgagcccatgtacaagaaactcgtgcaggccctctgctccgaacatcaaataccattagttaaggtcgactcaaacaagaagctaggagaatggtccggtttatgtaaaattgacaagacaggaaacccaaggaaggttgtcgggtgctcatgtgtagttattaaggactggggcgatgatacacctcacctagatgtactcaaagattatatgacagaatccatg

SEQ ID NO: 395 - DNA, 375 bp, artificial sequence
  Nezara viridula
atgtccggacgtggtaaaggtggtaaagccaagggtaaggcaaagacccgatcttcaagggcagggctccagttccccgtcggtcgtatccaccgtctcctcaggaaaggtaactacgccgagagagtaggtgcaggagctccggtgtatctcgccgcagtcatggagtacctggctgctgaagttctcgaattggccggcaacgcagctcgcgataacaagaagacgaggatcattccgcgtcacctccagctcgctataaggaacgacgaggagttgaacaagctgttgtcgggagtcaccatcgctcaaggcggagtacttcccaacatccaggccgttctgctgccgaagaagacagagaagagctcttaa

SEQ ID NO: 396 - DNA, 4497 bp, artificial sequence
  Nezara viridula
atgaatttgagagctgtcataatcgtattggtcgctgtttcggcgcttccaggctacgctcaagaaaatgggaccaacttgcttccacggacaaaaagaaatcctacaaaacttcgccattctcgacgttttgctgaaagaatgcccacctcttcctactatgatgactacccgcctattaccaatagccagaatcaggaaaatcataaaccaatattcaccaactgttcaatgtatcaaccttctgttcctgaagagttgacacatacaaccactgttatacaggttactgcggctgataaagatccacctgaagcaggaggaaaagtgacttatacttttgttgcaactccacaagaaagtcagaagttcaatatcgatcctgaaactggagttattactactcgacacagtttcgatcgagatgaaccgaatcgtgaaaaagaagtttatttaacagttcgagctaccgataatggaaggccacagcttgatgatgtctgtacatttaaaattattattgaagatattaatgataaccctccagtatttgataaagttgactaccaagaatccgtacctcaagatttaccacctaaacgtgaagtaatgagaatatctgctactgatgttgatgatggaaacaacagtattgtaatgtacagtttagaaccaagatctgcagatctaagtactaaaagctattttcaaattgacagtaaaaccggtgttatcacccttgatcgagcgattgatcgtgatcctggttataaatttaaactcagggctacagccacagatcatggagatatccctaaatctgcagttattaacctagacattcaagtagttgagtctaataagaaagctccagttttcacatcaatacctgcctcacctattgttcttctggaaaatttcactgacttcactgaaaatattgctactttaaccgctatgtctaatgatgaaaaagctcctgtttttgaattagttactggaagaactgagcagaccaataaatatagtacatttcggttagagtctgatgcaaacactgctcatattaggcttgccaggcggatggattatgaatcgattgcagaatatacactcacaattcgaatacagaacaaattcaatctggcttctgagactagtattaatatccagttagaggatgtcaatgacaatattcctgcctttactgaagttgtatcaggtgttgtattagaaaatgaacctgctggaacacctgtcatgcaagtcagggccattgatgcagacagtaccactgctcacaaccaggtcacctatgaattggcagataataccgaaaatttcgctattgatagatacactggaaacattactacaaaaaagatgtttgatagagaagaacaagatttttacaatgttaaggtcattgccaaagataattctccatctgctttatataaaactggagtacctaatgaaggtcaacaagtgtttcgaattgaaatagctgataagaatgatcatcctccaaaatttactgaagcagtatatgttgctgaagctatccctgaaaatgctaatactaatgctcgtgttacccaagttaatgctcaagacaacgatactgcttcacttgttcattatagtatattttatggaaatgaaaatgatgcatttgtaattgatgaaataactggtgaaatccgtgtcaataaaaatttagattatgaaaccaggaccaattatactttaaaagtgaaagcttttgatggagcttatgaagacaactgtgaggtgcatataaaaattgaaaacgtcaatgataatcctccagtttttgtttcttaccaaaagacaatcactataatggaagaagaattattcccaggatgtattgctcagcttgaagcttatgacccagatattcctgacagaagtctgcctcagcatatactttattttgttgtaaaagaacagcaaagtaaatggttaaatatcaacaaaaaaggttgcctttcactaataaagcctctagatagagatcctcctaatggcaccgagtcttggcaagttttgattggagctaaagatgaagatggtggacccactggggtgcaacagaccacagaggttatcattatgttaacagatataaacgacaatgctccatatctagaaatgtcacaaccagtaatttggacagaaaatgaacctcctggtgatattgtgaaattgaatgctaaagataatgatgggcctgaaaatggtccaccttttactttcaacattgctccttctgccagcactgaaatacaaaccaaatttactatatcaggttcaacattaaaatcacttgtcaggtttgatcgtgaagagaggaaatcttattttgtaccaattgctatcactgatagcggcaatcctagtttgactggtacaagcacattacatgtagtcattggtgatgttaatgacaatccaatgaaaagtggatatagtgaaatttttgtttacaattacaagggagaggctccagatacagacattggtagagtatatgttgaagaccctgatgattgggatttgcctgacaaacattttgaatgggctggtatggctggcccttactttgatttggatcctaaaactggaatgatcacaatgttacaaggaactgttgatcaatcatatattcttaactttactgtttttgaaaacgctactagatattttagtgctcacagtgtaacagctactgtaaatgttactgtcaaagaaataccggaagaagcagtcgataagtcaggctctgttcgtttagttggtatcactgctgaagaatttgtggaagcggattctaatggtattagcaagcgaacaatgtttagaaaatatttagcaaaattcttgaacattactgaagaaaatgttgacgtttttactgttttacattctcctcacaatgcaaatacaagcctattggatgttcgattttcagcccatggatctccttattatagtccagaaaagctaaatgctgcagtgagtgtgcataatgctgagctggagaaagagctcggagtggcaattcttatggtgaacattgatgaatgccttgttgaaagacagtattgtgaaggttcatgtataaattttttgaataaaagtcgtgaaccgattgcagtttacaccaatacaacaacttttgttggtgtaagggctgttgtagatcctttttgtaactgtgaagtacctcctaggccagtttgccataatggtggtacacttgttaataatgacaagtgtgaatgtgaacctggctttgaaggaccgcattgtgagatcctaagtattggatttagtggcaatggttgggctctttatcctccattagaatcatgtgctgattcacatctctctttagaacttcgttcaaataaaaaggatgggcttgtattttacgtgggaccaactaaaccaaatcgactgatgaatgtgcaagattttatctcttttgaagtggtagatggctacccagttcttctgttggattttggaactggtactgtaaaactagatcctaaacaaattagacttgatgatggtgagcaacatcgcattgacataatttggtctagaacaactattgaattacaagttgataattgcaagttaccttcatgtttaagcctaaaattaaaagcaggagacaatgaatttttaaatgtaaatggaccattacaagtaggaggttcatttgttgacttcaattaccttgataatcacatgaactggactcataaaccttcaagagttggatttagtggttgtgttaagaatttcacctttaataataaattgtataaccttggaatgcctggatattcaaaaaatgcagacattggttgtaatgctggtgtagctgttgcagtatcttttggaatagatcctagttttataattgcgattattatatgcttagctatattactaatattgttattggcggttgttgtacatcgtagaaaaactgatgacctttacaaagacactgatgatatcagagagaatatcattaattacgaagatgaaggtggtggtgaaggtgatatgactgcttatgatcttaatgtcttaagactcatgtacaatgatgctatacaggacaaacctcttccagatcatatgaattcaaggccagatgaagttcctgatatatgtggttttctggatggaaaaaaacagtctgttgataatgaccccgaaactaatccttttgatgatgttaggcattatgcttatgaaggcgatggaaatactacaggttctctatcatcattagcttcaggaactgatgaaggtgatttgaattttgattatttatctaactttgggccacgtttccggaagcttgctgatatatatgggaaagattctagtgatgacgatgatgatgatgataattaccaaaccactgcatctgaaagctggtgttaa

SEQ ID NO: 397 - DNA, 1164 bp, artificial sequence
  Nezara viridula
atgtctgacgaggagtattcggagtccgaagaggagactgtaccagagcccgagcctcaaaagaagactgagcgtagacaatctgaaaagggcgatggagatccagaattcgttaaacgccaggaggctaaaacatcagctttggatgaacaactcaaggattacatagcagaatggagaaaacaaagggcgaaagaggaagaggacctaaagcgcctcaaagaaaagcaagccaagagaaaggtcatgagagctgaagaagaaaagagactcgcagaaaagaaaaagcaagaggaagaaaggcgagtcagagaagctgaagaaaagaaacagagagacattgaagaaaagaggcgtcgacttgaggaagcagaaaaaaaacgacaggcaatgatggcagctcttaaggatcaaagtaaaagcaagggtccaaacttcacaatcagcaaaaaggaagctggtctaaacttgtcttcagcacaaatagaaaggaacaaaacaaaggaacaattagaagaagaaaaacgtatctcccttagtataaggattaaaccattaaatattgaaaatctaaacattgacagattacgattaaaagctattgaactctgggattgcattgtaaaactggaaactgagaagtatgatcttgaggaaaggcaaaaacgtcaagattatgatcttaaagaactgaaggaaagacaaaagcagcaactgaggcacaaagcactgaagaaaggtttagatccagaggctttgactggcaaatatccacctaaaattcaggttgcatctaaatatgaacgcagagttgacacaaggtcatatgatgacaagaagaaactttttgagggcggttgggaaacattgactgctgaagaattagaaaaaatatggaagtctagatatgaacaatttactaagcgaaaacatgctaaattgcctaaatggtttggtgagagacctggcaaaaagaaggatgctcctgaaagcccagaagaggaagaagtgaaaccaaccgatgatgatgtagaacctgtctatgctgaagaagaagaggagggagctgaagaagaggcagaggaagaggaggaggaagaagaagaggctgaagaagaagaagaagaggaagaagaagaggaagaggaggaagaagaagaataa

SEQ ID NO: 398 - DNA, 852 bp, artificial sequence
  Nezara viridula
atggacgcgatcaagaagaagatgcaagctatgaagcttgagaaggacaacgcgatggaccgcgccctcctgtgcgagcagcaggccagggatgccaacctgagggcggagaaggctgaagaggaggcgaggtccttgcagaagaagatccaagccatcgagaacgacttggaccagacgcaggaacagctgatgcaggtcttgcagaagcttgaggagaaggacaaggctctccagaacgctgagagtgaggttgccgccctcaacagacgtatccaactgttggaggaggacctcgagaggtctgaggaaagattggccaccgcaacagccaagttggccgaagcctcccaagcagcagatgagtccgaaaggcagagaaaggttcttgaaaaccgcagcttggctgatgaagagcgtatggacgcccttgaaaatcagctgaaagaagccagatttctggctgaagaagctgataagaaatatgatgaggtcgcccgtaaattggccatggttgaggctgatttggagagagcagaagaaagagccgagagtggtgaatcgaaaattgtagagcttgaagaagaacttcgcgtagttggtaataacttgaaatcactggaagtgtcagaagaaaaggcaaaccagagagaagaagaatacaagaaccaaattaagacccttacaaacagacttaaggaggctgaagctcgtgctgaatttgctgaacgttccgttcagaaattgcagaaggaagtcgacaggctggaggacgaacttgtccacgaaaaggagaagtacaaatacatctgcgacgatctcgaccagaccttctcagaactcgtcggttaa

SEQ ID NO: 399 - DNA, 789 bp, artificial sequence
  Nezara viridula
atggctgttggtaaaaataaggggctctccaaaggaggaaagaagggagttaaaaagaaggtagttgacccttttacaaggaaagattggtatgatgttaaggccccatctatgttcaacacccgtcaaatcgggaagacccttgtcaacagaactcaaggaactaaaattgcttctgagggactcaaaggtcgagtatttgaagtgagcttagctgatcttcagaacgatactgatgccgaaaggtcattcagaaaattccgcctcatcgctgaagatgttcaaggcaggaatgttttgaccaacttccatggtatggacttgaccacagataaactaaggagcatggtcaaaaagtggcagactttgattgaagccaatgttgatgtgagaaccactgacggctacttgttaagagttttctgcattggattcactaacaaggaccagatgtcccagcgtaaaacttgttatgcccaacataatcaggttcgagccattaggaaaaaaatggttgataacattaccaataacattagtaacagcgatttaagggttgttgttaacaagctcatccccgattcgatagcaaaagatatagaaaaaatatgccaaggcatctatccccttcatgatgtctatattaggaaggtcaaagtattgaagaaaccaaggtttgagttgagcaaacttctcgaactgcacggtgatggcaaaggctccgacgaacctggttcaaaggtttcaaggcctgaagcttatgaacctccagttcaggaatcagtttaa

SEQ ID NO: 400 - DNA, 663 bp, artificial sequence
  Nezara viridula
atgggaagaagaccagctcgctgttatcgctactgcaaaaacaaaccttaccccaagtcaaggttttgtcgtggtgtgcctgatcctaagatcaggatttttgatcttggaaagaaaaaggctcgtgtagatgatttcccattatgtgtacatcttgtgtctgatgaatatgaacaactttcatcagaagcacttgaagcaggacgtatctgcgccaataaatatctagtgaaaaattgtggtaaagatcagttccatattagaatgagattgcatcctttccatgtcatcaggattaacaaaatgttatcgtgtgctggagctgataggctccagactgggatgagaggagcttttggaaaaccacaaggtactgtggctagagtacacattggtcagcccatcatgagcgtccgttccagtgacaggtacaaggctgctgtcattgaggcactcaggagggccaagttcaagttcccaggaaggcagaagatctatgtttccaagaaatggggtttcaccaagtatgacagagagacatttgaggaactgcgtgcagatgggaagttggcaaacgatggttgcaatgtgaagtacaggagggatcatggacctttgtccaattggaaaaaggttcaagttgaactggctgctgctagttaa

SEQ ID NO: 401 - DNA, 711 bp, artificial sequence
  Nezara viridula
atgacttgcgccacccctatttcgaagaaaaaaaagttcgttgcagatggtgtgtttcgggcagaattgaatgaattcctcactagagaacttgctgaagaaggttactcaggtgttgaagttcgagaaactccaagcagaactgaaatcatcatcatggcaacaagaactcagagtgtacttggtgaaaaaggacgacgcatccgagaattaacctccgtagtgcaaaagcgttttaattttcaaccacaatcattagatttatatgctgaaaaagtacctacgagaggtttatgtgctattgctcaagctgagtctttgaggtacaaactgattggaggtcttgcggtccgaagagcttgttacggagtattgagattcataatggaaaatggagccaagggttgtgaggttgtagtttcaggaaaactgagaggccaaagagctaaatccatgaagttcgttgatggactcatgatccacagtggtgacccctgtaatgagtacgtgaactcagcaacccgtcacgtattattgagacaaggtgtacttggcattaaagtcaaaattatgctgccatgggacccaaccggaaagaatggacctaagaatcctctgcctgacaatgtctgtgttgtcaaccctaaagatgaagttattccttcagacattaagactatgggaattgaactacatcctccagccatttaa

SEQ ID NO: 402 - DNA, 354 bp, artificial sequence
  Nezara viridula
atgtctaaggcagaattagcttgtgtatactctgcactcatccttgctgatgatgatgttgccgtaactggagagaaaatccaaaccatccttaaagcagcaggtgttgatgttgaaccctactggcctggcctcttcgctaaggccctcgaaggtatcaatgtcaaggacctcatcaccaacatcagcagtggtgtaggtgttggcggtggtgcaccagctgcagctgcaggtggtgctgcccccgctgctgctgcagccccagccggtggtgacaagaagaaagaagagaagaaaaaggaagagagcgaacctgaatcagatgatgatatgggcttcggtctgttcgactaa

SEQ ID NO: 403 - DNA, 657 bp, artificial sequence
  Nezara viridula
atgagttttcttagcaaagtttttcttggtaaaaaagaagaaaaagcacccacagcttctgaagcaatacaaaagcttcgcgaaactgaggatatgttaattaaaaaacaagattttttggaaaagaaaatcgaatctgagctaagtctcgtgaagaaaaatggaactagtaatagaagagttgcaatccaagcactcaaaagaaaaaagaggtatgagaaacagttacaacaaattgatggtactttggctacaattgaaatgcaaagagaagctttagaaggtgctaatactaatacggctgtacttcaaacaatgaaatttgctgctgatgcattaaaaactgcccataaacatatggatgttgaccaagttcatgatatgatggatgaaatcgctgagcaacaagatgttgcaaaagaaatatcggaagctatttctaaccctgtcgcttttggaaatgacattgatgaggaggaacttgaaaaggagcttgaagaattagaacaagaagagttagacagggaacttcttggaactggtcccactgctgatcaattacctgatgttcctgctactcagttgccagccaaaccaaagccaattgcatcagaagatgatgaagaattaagacaattacagcaatgggcaacatga

SEQ ID NO: 404 - DNA, 456 bp, artificial sequence
  Nezara viridula
atgggtcgtatgcacgctcctggtaagggtatatcccagtcagctttaccatatcgaagaagtgtcccaacatggttgaaattatcacccgaagatgttaaggaacaaatctacaaattaggaaagaagggcctcactccttcacaaataggtgtcattcttcgagattcacatggtgtggcccaagtacgattcgtaactggaaacaagattcttcgaatcatgaaggccatgggattagctcctgatcttccagaagatctgtactttcttattaagaaagccgtcgctatcagaaagcatcttgagaggaacaggaaagataaggattccaagttccgtcttatcttggttgagtccaggattcacaggcttgctcgctactacaaaaccaagggcggactcccacctaactggaagtacgagtccagcactgcatctgctcttgttgcttaa

SEQ ID NO: 405 - DNA, 1293 bp, artificial sequence
  Nezara viridula
atgattcccccgtcttctcggccgcaggtcactgtgtacagtgacaaaaatgaaccaactggtgaattattgactctacctgcagtctttaatgctccaattagaccagatgtcgtcaattttgtacatcaaaacatagcaaaaaatcacaggcaaccttatgctgtcagtgctgaagcaggtcatcagacttcagctgaatcatggggaactgggcgagctgtggctcgtattccccgtgtaaggggtggtggtacccaccgttcaggccagggtgcattcggtaacatgtgtagaggtggacgtatgtttgctcccaccagggtatggcgcagatggcaccgcaaggtgaatgttaatcaaaagaggtatgcaatggtatctgctattgctgctactggagttccagctctcgttatgtccaaagggcacatggttaacgaagttccggaaatccctcttgttgttactgataagatccaagagtatactaaaaccaagcaggccacaatctttttacatcgtatcaaggcctggtctgatattcagaaggtctacaaatctaaaagattccgtgctggtaaaggtaagatgcgtaataggagacgcattcagcgtagaggaccactcatcatctatgggcaagatcaaggtctaactcgtgctttccgtaacattcctggtgttgatcttatcaacgtttcacggttgaacttgcttaagctggcacctggtggtcatgttggaaggtttgtgatctggacccaatcagcttttgatcaacttaacgctctctatggcacatggaagaaaaaatcaactttgaaaaaggactacaacttgcctatgcccaagatggttaatactgacctgtctaggctgttcaagtctgaagaaatcaagagtgtccttaaagcaccaaggaagaccatagttaggagggttaggaaactaaacccattgaggaacactcgagcaatgctcaagctcaatccattcgctgcagttctgaagaggaaagccatacttgctgataggaaacttaagcttgagagggctattgagagatcaaagaaggaaggaattgagcttacccctcatcaaaagaggtatgttgctatgctcgagcgaaggaaagctcagatcaaagctgctaaggctgctaagcctaaaaaggtcaagaaaccaaaagctgaaaaaactgaagctgctgaagcaaagaaagctagtgtaactaaaaaaccagcaaaaaaggcaacaacagctgctgctcccaaacctgccaaaaaatga

SEQ ID NO: 406 - DNA, 690 bp, artificial sequence
  Nezara viridula
atgttaaaatcgcaaaggccttggcataaagtgttctcgtgtagtgctttcaggaacccttccattttaagtgaaatgacggggttttcggacaagcccatcttaattgatggcaaaggtcacttactgggtcggcttgcagctatagtggctaaagctgccttgaatggcaacaggatagttgttgttaggactgaacaaattaatatttcaggaaactttttcaggagtaaacttaagtatttgtcattcttaagaaaaagatgtaatgttaatccagccagaggtccttttcacttccgggcacccagcaaaattttgtatcgaactatcagaggaatggtgccacacaaaatcgaaagggggaaggctgctttgaggcgtatcaagttgtttgagggaatccctcccccctatgataagaggaaacgagtagttgttccgacagctatgagagtattgtgcttgaaacctggtagggcttattgccatcttggtaggttgtcttctgaagttggttggaagtacaaggatgtagtgagagctcttgaaaccaagaggaaagtcagggcagtttttgatattcgcaagagaaattccctaaagaaattgactaaacaagccaaggaaaagatgtccaaagcaaatgctaattatactgctgtaatcaattcctatggatatcgttaa

SEQ ID NO: 407 - DNA, 3585 bp, artificial sequence
  Nezara viridula
atgtcccctcccgggcatctaccaggggtggtcgggtgtgaggtcggcgaaccactctcatggaataagatgagtggatcggccagtggttcctcatctaagaaaagaaagaaacctgaaaacaaacctcagtctcagattaacaagtgccttaatgaaaagcggaggagggagcaggagaacatatacatcgaggagcttgccgagcttatctctgcctccttcacagacatgagcagcctctctgtcaagccggacaagagtgccatcctacaggagaccgttcttcagatcaagactataaaaggcagaacagcgactagcgatgccgtccaacaaggagaagtctcatcgagcaagcctaccattctagctaatgaggtttttggcccgctcttacttgaggctttagatggcttcctttttattgttaatcctgaagggaaagttgagttttgtactgagaatataactcagtttatcaaatattgccgtgaagaggttcttggtcagccggtgtataatataatccaccacggggaccacgccagattttcatcttggttgttgcctatgagttggtctaacgactaccaaccaccaagaccgagaacttttaactgtcgtttcctcatcaaacctcccccagatacgactgtagaagaaaaacaacaaagaccgtccaaatatgaaaatatgcagatctcttcaacccagcttcctcaaagcagtggtatagacaaagatgatgatggtagtagtgagtctggaccttgtttgatgtgtatagctagaagaatccctccaaacgaaaagccagctgggtctcccatcgagcagtttactatgaaattaaatacctcaggaaggattattaagatagataatactggtgtttcagctccttattctcagtactttagtaagcaggatctaatgcatcggaatttagatgaacttgttcaaagtagtgatgtgcccaaagtggttggtcatgtaaaagacgcattgactacagggcaaagctctacgtccatttataaacttcaaattggccatgacaaatatgttaatgtacaaacaaaatttaagctatttaaatcagccaatcgccagatggaaaatgactttataatggctactcattccatatttggagataatgaagccaatcttgaaattggctctcctgctggtaacagcaatcaatcaggaagtggaaacaacaacactaaccaacagcagcagcaacaaatgcaaccacaacaacagcagagctcttccaccggtggagtcggtggtccacttattgctaacggtgctaacagagatctgggtaacaccatcactctcaacaccagcacctcttttggttccgtcactctcaactcggctgatatagatatattatcctcctttgattttccaagtacaacctggccggaaataagcagcgatttagaatggaaaaagtctgagtttcgtactccagttcaaagtccagtacttcccaatccaccagctcaatcccccaccgccactcctttttccactccatattctttatcaccaattcatgaggatgctccagaggaagattctgttaggctccgaaaccttctcacaaccaagaggccatctacggagtcagatgatggtggtggaggtaatattgctcagcgtaataacaaccgaatattgaagaatcttcttaaccaagaggatgaagaatcacagccccaggattctaaaccaccaaataacatgctactaaagcttttgaacactcagagtgatgatgatgatgtggaggctagggctgggttgaagaaacagaatgagcttctccatcaactgctcaaggaagaggataacaaccaagacaaccagcaaagtggtgacgatggtctcctcaaaagccttggattcaggggagaagggagtgaggaaagtagagggggaaggaaacgcccgtcttcagatgaaagtgaagaccagccaggttcaaagagatcttcctcttctctgttagatgctgtgcctcctcccccgaccccctcggcaccctctgctgcatccggtaaatcgaggctttgggagaaaaaccagatgcttgcatctcttttagcaaagcgtcctactactccagcttcgattccaccaatccctgcatccgtaatttctgctacgcctcaggataagctgcaacgtcttgttaaacatcctcctacaggctggtctggaggtagcgtccaagccggcgcaggctcacctggtcagagcaggtcaggacgcagcccaggctacactggggccaacacctgggactcggcctcttcagatccagtcctctcagacatccttgatcaagtcatagagatagtacctgatgttaatacagatgcaccagtactaatgaatatgatcaactcattggaagctgagactcagccatctgttcaacaacaatttgcatctcagcaagaatttttgaatgaaaagatggcgataaacgctatacaaaagtctttgatgctctgcgaatctgctgttaaaagccctacctatcaaactacaatgtcccagggatctcctcaggcacaaccacagcctcagccccagcaacaatctcaacctcagcagcagcaacagcagcagcaacaatttcaccctccgccaatgtatcaacaaagacaaaggtttcccattcaacaacagccacaaatcaggcaacaacaacaatttagcatttcgccgttgttaatggctcagcggaaaatgcttaaccataatcagcagatgcaacagaagcagagacttctccagttgcagcaacagcaacagcttgtgattccatctaatgctactgcccaaaatgctgaccccgcgctccacaatattgatagccttatcaataatacggttgctccgaacgtatctcttcagagatcaagcagcgttcccgattctcagctgtcccctgttggaagttaccctggcctaggatctgtaccatcaccaggacagagaaggcctttctcacctgtcaacggggggatgacgagtttctcgagcggtggtggcgcgggcccccccgtgtcaggaagtggcccccaagccagactttcccccagctccctccaaggataccagcaacaaccccagctgtctccaaggctcactcagggccagcaaaactatggtggcggtggtgctagctggtctcagcagaattctcggctttctgtgcagcaacaggaaaaccctgtcctcaatgctcaattgacgagcggaggacgaggatacgctaggaatacttcagccgggttaccccctgtgaggtcactggctggcccacagcgattccccaccgcggctgaccaacaggctggtgctgcttcataccaattccggctgcagcgccaggtgtcagcacctccacctcaacaatcatcacccaacccacagttaccaggtggtaataatggcgtgacagagtatgtgaggcaagagctgcgcgcgatggtgggcgccagaacgagcgccggcgggcgcccccaggtccccggctctcttcccctcccc

SEQ ID NO: 408 - DNA, 525 bp, artificial sequence
  Nezara viridula
tttcaaaaaatattgttagggcggactggtaacaacaacgtgggtttctttgaggttcttcacgaatcgtcggtgcgtcggattatcaatttcatccgaattcatcaatccaaaatggggaagattatgaaagctggtaaggtggtgttggtgctgagtggtaggtatgcaggaagaaaagccatagttcttaaaacttgtgatgaaggaacacaagagaaggcttatgggcatgccatagttgctggcattgatcgctacccccgtaaagttcacaaaaggatgagcaaaactaagatccacaagaggtctaagatcaagccctttttgaaggttatgaactacaaccaccttatgcccactcgttacacagtatctgagatcgctcctgaccaaaaggtagtgacaaaagatttgaaggacccaatgaagaaaaagaagatccgtttccaagttagggtgaaattcgaagaaaggtacaaacaaggcaagagcaagtggtttttcgaaaaattgaggttttaa

SEQ ID NO: 409 - DNA, 597 bp, artificial sequence
  Nezara viridula
atggccgtgcaaaataagaaaaagggcgctgctgcccctgagaagaaaaaatccctcaaaaaggaacctaaggacaagtcaaaaaatgttatgaaagaagtcagaatccgaaaactctgcctgaatatttgtgttggagaatctggcgataggctgacaagagctgctaaggtgttggagcagttgactggacagcaacctgtcttttctaaagctaggtatactgtaaggtcttttggaatccgtaggaatgaaaaaattgctgttcattgtacagttcgaggagccaaagcagaagaaattttggaaagaggattaaaggtccgggaatatgaactgagaagggataacttctctgacaccggcaattttggatttggtattcaggaacacattgatttgggaatcaagtacgatcccagtattggtatctatggtttggacttctacgttgttcttggacggccaggtttcaatgttgcccaccggcgaaggaagactggtgtagttggtttccaacataggttaacaaaagaagatgcgatgaaatggttccaacagaagtatgatggaatcatcttacctggaaagaagtaa

SEQ ID NO: 410 - DNA, 5856 bp, artificial sequence
  Nezara viridula
atggcgtcgaaaggacctgcaggtatgcaagtaggggctgatgaccccgatccaaccccatatctcttcgtatccctggaacagaagagaatcgatcaaacgaaaccatacgacgccaagaaggcttgctgggtccccgatgaagccgagggtttcctccagggtgaaatccaaggaaccaagggagacatcgtatccgtcaagctccctggtggtgaaacaaaagacttcaagaaagatctggtcggccaagtgaatccacccaagttcgagaaatgcgaggatatgtccaacttgacctacctcaacgacgcttctgtcctgtataaccttaagcagagatactatcataagctaatttacacatactccggtctgttttgcgttgctatcaacccttacaagagattccccgtatacacattgaggtgcgccaagctgtacagaggtaagaggaggaatgaagtcccacctcacatctttgccatctctgacggtgcctacgtaaacatgttgacaaacaaggagaaccagtctatgttgattactggtgagtctggtgccggaaagactgaaaacacgaagaaagtaattgcgtacttcgccactgttggtgccagcacaaagaaagatgaagcatccgaaaagaagggtaccctagaagatcaagtcgtacaaactaaccccgtactagaagccttcggtaatgccaagacagtccgtaacgataactcttctcgtttcggtaagttcatccgtatccacttcggaccatcaggaaaactggccggagctgatattgagacctatctactggagaaggctcgtgtcatctcccaacagaccctggaaagatcctaccacattttctaccagatcatgtctggtgccgtcaagggagtcaaggccaagtgcttgctttctgacgacatttacgagtacaacttcatctcccagggtaaagtcactattgcaggtgtagacgatgcagaggaatttcaactgacagacgaagccttcaacgtcttgggtttcacccaacaagagaaggatgacatctacaagatcaccgctgccgttatgcacatgggttgcatgaagttcaagcagaggggtcgcgaagaacaggctgaagccgatggtgtcgaagaaggtatcagggtcggtaaactcctgggtatcgacggtgaagaactctacaagaacttgcttaagcccaggattaaggtcggtaacgaattcgtcacccagggtaggaatgtacatcaggtaacatactcagtaggtgccatgtccaagggtatgtttgatcgtctcttcaaattcttggtcaagaaatgtaacgagaccttggacaccaaacagaagaggcagcacttcattggtgtactggatattgccggttttgaaattttcgactacaatggcttcgaacaattgtgtattaactttacaaatgagaaactacagcaattcttcaaccaccacatgttcgtcctggaacaagaagaatacaaaaaagagggtattaattgggccttcattgatttcggaatggacttgctggcttgtatcgaacttattgaaaagcctatgggtatcctctcaattctcgaggaagaatctatgttccccaaggctaccgacaagacctttgaggacaaactgaactccaaccatcttggcaagtcccccaacttccagaagcccaaaccaccaaagccaggttgccagcctgctcacttcgctatcggtcattacgctggtgttgtatcatacaacatcaccggatggctggaaaagaacaaggaccctctgaacgacactgtcgttgaccagtacaagaagggttccaacgcactcttgtgcgaaatctttgctgaccatccaggacagtctggtgctgctggtgctgatgctggtggcaagggtggccgtggaaagaagggtggtggcttcgccaccgtatcttcctcctacaaggaacaattgaacaacttgatgaccactctgaggagcacacagcctcactttgtccgttgtatcattcccaatgaattgaaacagccaggtgtcatcgactctcacctggtcatgcaccaactgacttgtaacggtgtacttgaaggtatccgtatttgccgtaaaggtttccccaacaggatggcataccccgacttcaagctccgatacaagatccttaacccagctgccgttgagaaattaaccgacgagaaagcaatggccggagtcatcttggaatccacagggctcgatcccgacatgtacaggcttggccacaccaaggtcttcttcagggctggtgtcctgggtcagatggaggaacttcgtgatgaaaggcttagcaggatcatctcctggatgcagtcatacatccgtggttacctctgcagaaaggaattcaagaaactccaagaacagagactcgccctccagatcgtccagaggaacttgagaaggtacctcgccttgaggacatggaactggtggaagatgtggtccaaagtcaagcctctgctcaacgtagccaacgtagaggaagagatgaggaaattggaggagttggtcgcccaaacccaagccgccctcgagaaggaagagaaggcaaggaaggaggttgaggccctcaatgccaagctgctcgctgagaagaccgagctcttgaggaacctcgaaggagagaagggcacccttggaagtcttcaagagaggtctgccaagctccaggcccagaaggctgacttggagtcccagcttatggacacacaagaaaggcttcaacaagaagaggacgctaggaaccaactcttccaacagaagaagaaacttgaacaagaaaacagcagtctcaagaaggacattgaggaccttgagctttccgtcaccaagagcgaccaagacaaggctagcaaagaacatcaaatcaggaacctcaatgatgagattgcccaccaagacgaactcatcaacaaactcaacaaagaaaagaagatccagagtgagcacaatcagaagactgctgaggaacttcaagccgccgaagacaaaatcaaccacctcaccaaagtcaaagccaaactcgaacagactttggatgaactcgaagactcactcgaaagagagaagaaacttcgtggagatgttgagaaggccaagaggaagactgaaggagacctcaaactcacccaggaagctgttgccgacctcgaaaggaacaagaaggaacttgaacagaccatccagaggaaagacaaggaaatggcttccctcactgccaagcttgaagacgagcaaggcattgttaacaagaccggcaaacagatcaaggaactccaggcccgtattgaagaacttgaggaagaagttgaagcagagagacaagctcgtggaaaggccgagaaacaacgtgccgacctcgcccgcgaacttgaagagctcggtgagaggttggaagaagctggtggtgctacttccgcccaaatcgagctcaacaagaagcgagaagctgagatgagcaaactcaggagggacttggaagaagccaacatccaacacgaaagcacccttgccaacctccgcaaaaagcacaacgatgccgtcagcgaaatgggtgaccaaattgaccagctcaacaaacttaagaccaaggttgagaaggaaaaatgccaatacctgtgtgagttgaacgacctccgtgcttccatcgaccacttgaccaacgagaaggctgccaccgaaaagattgccaagcagctccaacaccaactcaacgaagtccaaggaaaactggatgaagccaacaggtctctcaacgacttcgatgccgccaagaagaagttgtcaattgaaaactcagatctcctcaggcaacttgaggaggctgagagccaagtatctcaattgagcaagatcaagatctccctcaccacccaattggaagacaccaagaggcttgccgacgaagaggctagggaaagagctacccttctgggcaagttccgtaacttggaacacgacctggacaacctcagagaacaggttgaggaagaatctgaagccaaggcagatatccagaggcaattaagcaaggctaatgctgaggctcaactctggaggcacaagtacgagagcgaaggtgttgccagagctgaagaacttgaagaagccaagaggaaactccaggccaggctcgctgaggctgaagaaaccatcgaatctcttaaccagaaagtcattgctcttgagaagaccaagcagaggctcgccaccgaggtcgaagatcttcaactggaagtcgaccgtgccaatgctattgccaacgctgctgaaaagaaggccaaggctatcgacaaaatcattggtgaatggaaactcaaggttgatgaccttgcagctgaacttgatgccagccaaaaggagtgcaggaactactcgactgagctcttcaggttgaagggagcatatgaagaaggacaagaacaattggaagctgtccgcagggagaacaagaatcttgctgatgaagtcaaggatctccttgatcaaattggtgagggtggacgcaacattcacgaaatcgagaaacagaggaagaggctcgaagttgaaaaggacgaactccaagcagctctcgaagaagctgaagccgcccttgaacaggaagaaaacaaggttctcagagctcaacttgagcttagccaagtcaggcaagaaattgaccgtcgcatccaggagaaggaagaagaattcgaaaacaccaggaaaaatcaccaacgtgccctcgactccatgcaagccagtttggaggcagaagctaagggtaaggctgaggcactccgcatgaagaagaaacttgaagctgacatcaacgaacttgaaatcgccctcgaccatgccaacaaggccaatgctgaagctcagaaatccatcaagaaataccaacaacaacttaaggatgtccagaccgcactcgaggaagaacaaagagctagggatgatgcccgggaacaacttggtattgccgaaaggcgagccaacgctcttggaaacgaactcgaagaatccagaactctcctggaacaggcagaccgcggccgtcgccaggcagaacaggaactcaccgatgctcacgaacaaatcaacgaactcgcagctcaagccacaagcgcttctgctgccaagcgcaagctcgaaggagagttgcagacactccatgccgacctcgacgaacttctcaacgaagccaagaactcagaagagaaggctaagaaggctatggttgatgctgcgaggttagcagatgaactcagagccgaacaagaccatgcccagacccaggagaaactccgaaaggccctcgagacacagatcaaagaactccaggtcagactggacgaagccgaaaataacgccctcaaaggaggcaagaaggccattgccaagttggaacagagagtcagggaactcgaaaacgagcttgacggagaacaaaggagacatgctgatgcccagaagaacctccgcaaatctgagcgcaggatcaaggagctcagcttccaatctgatgaagataggaagaaccacgaacgcatgcaggaccttgtagacaaactccaacagaagatcaagacttacaagaggcagattgaagaagccgaagaaatcgctgccctgaacctcgccaaattccgcaaagcccaacaggaacttgaagaagctgaggagagagcagacctcgccgaacaggctgttactaagctaagaacgaaaactggaggcagagctggatcaactgcaagagccatgagcccagtgaatcgcaaccctatgaggccc

SEQ ID NO: 411 - DNA, 768 bp, artificial sequence
  Nezara viridula
atgagttctataggaacagggtatgatctgtcagcatcacagttttctcctgatgggagggtttttcaagttgaatatgcacaaaaggctattgaaaacagtgggactgttattggtctgagaggtaaagatggtgttgttttagcagtcgaaaaattagtcacatcaaaactatatgaaccgggtgccaataagagactgtttactattgacaaacatattggaatggctgtagccggattaatatcagatgcaagggcagttgcagaagtggctaggacagaagctgcaaattacagatctcaatataagagcagtatacctcttaagtacttgaatgagcgagtgtctatgtacatgcatgcttataccctctacagtgctgtgaggccatttggatgcagtgtaatactcagtacttacacggaagaggacggcccagaaatgtatatgatagacccatcaggagtttcatatggttattttggttgcgctgttggaaaggcaaaacaggctgcaaaaactgaaatagaaaagctaaaactcaaagaaatgtcatgtcaggagctcgtaaaagaagcagcacgaattatttacctcgtccatgatgagctgaaggacaaacagtttgagcttgaaatgagttggattggctctcacacgaatggtgtaagtcaacaagttcctgccagtgtccatgccgaggcagagaaagatgctaaagccgcgatggaagaagattccgattcagaaacagaagatatatga

SEQ ID NO: 412 - DNA, 801 bp, artificial sequence
  Nezara viridula
atggttgaaacatctgtggttactcctgcagctcctgctgccaataagaaagcagggtcaaccagaaagcctcagaggagaaattacaacctcggttcaggagtttataggttcagcagaactcgcatgttccataagaaggctctatggaaatttattggtaagaaaacacctaagactccccgtcctaaaaggaaaactactcttgaaaaaaagattggtggtgagaaaaatggaggcactcgtactgtctatttaaagaaaaggactaaatcatatcctacagctaacaaggtgaggaaacacccaagtaaaacctatttttgtcagcacaagagaaggttccgtgcctccctaaaacctggttccattgtcattctgcttgctgggcttcacaaaggaaaaagggcagttcttttaaaaaatatgcctagtgggcttcttttggtttccggaccatacaccctgaatggagtacctcttaggagaatacatcctaactatgttattgccacctcgactcagatcgatttgtccggagttaagttacctgagcatatgaatgataaatatttcaagagggttaaagctaaaaaggccaagaagagtgatggtgaaatctttgctgctaaaaaagaactctacaaaccatctgaacagaggaagaccgaccagaaggaggtggacaaacaagttttgcaggccattaagaaacatgaacatagcctacttctcaggaagtacctgtgcacaatgttcggccttcgaagcagtcagtaccctcacagaatgaaattttaa

SEQ ID NO: 413 - DNA, 732 bp, artificial sequence
  Nezara viridula
atgtctaccaaagacaaattggccattttcccttctcgaggagctcagactttgatgaaaggaagacttgtgggcgctcaaaaaggtcacagtttgttaaagaaaaaagcagatgccctacaaattaggtttaggatgatcctcagcaaaataattgagacaaaaacgcttatgggagaggttatgaaagaagccgctttttcattagctgaagctaagttcgctactggagatttcaaccaacaagttttacaaaatgttcagaaagctcaaattaaaataagaacaaagaaggataacgttgcaggtgtgacactacccgttttcgaaagctatcaagacggaacagattcttacgagttggccggactggctagaggtgggcagcagttggcaaaactgaagaagaactatcagaaagctattaaattgctcgtagagctggcttcattgcagacttcttttgttacgttagatgaggttattaagcttaccaatagaagagttaatgctattgaacacgttattataccaagaattgaacgcacacttcaatatattatttctgaattggatgagttggaaagagaagaattctacagattaaaaaagattcaagataagaagcgtatcgcccgtcaaaaagcagaagcgaagaaggcggtggacgcagctgcagcaacgatggctagcaacattctcgaagagaacgacgaggatctcctgttttag

SEQ ID NO: 414 - DNA, 666 bp, artificial sequence
  Nezara viridula
atggctccgaaaggaaataatatgattcccaatgggcatttccataaagattggcaaaggtttattaagacctggttcaatcaaccagctcgtaaatatcgccgaagaatgaagagagtaaagaaagctagagctctggctcccagaccagcaacacttttacgtcctgcagtcaggtgcccaactgtgcgctatcatactaaattgagacctggcagaggcttcacattggaagaaattaagagggttggattatgccctggattcgcaagatctatcgggattgcagtcgatcataggagaagaaacaagtcggtcgaatctttacagttgaatgtacaacgcctaaaagaatatcaagctaagctgatcctgttcccatccaagaagagcaagaaggtgaagaagggagaagcttcggcggaagaacaggctttagctgcccaagtttcttcacctgttatgccaatcaagcagaccgttgtaaagatgaaagccagaacaattactcctgaggacaagagcttctctgcttatgcagctttaagaaaggcaagggcagatgaaagactagtaggaatcagagctaagaggctgaaggaagctgctgataatcctgaaactgttgagaaggctgcaaaacagaagaaaattaaaacaaaataa

SEQ ID NO: 415 - DNA, 618 bp, artificial sequence
  Nezara viridula
cctctatggctgtcgattccgtgtttatgtttgcagcaggttatagtgctactactacacgtcattttatgtaatttagatatggatgggttactattggaacctactctttacactgtgaagggaatggtaattttggacaatgatgggcaccgaatactagctaagtattatgatccaagtgtgtttccaacttctaaggagcaaaaggcatttgaaaaaaatttgttcaacaagacccatcgggctaatgcagaaataatcatgttggatgggcttacatgtgtttataaatcaaatgttgatttatttttttatgttatgggaagttcgcatgaaaatgagttgatattaatgagtgtgctccagtgcctttatgattctattagtcaaatattgaggaaaaatgtagagaagcgaactctgttagaaaatttagaaattgtaatgttagcaatggatgaaatatgtgatggaggaataatattagaggcagacccaacaagtgttgtacaaggagtagctttgaggacagatgatatcccacttggtgaacaaactgttgcacaggttcttcagagtgcaaaggagcaaattaaatctgcaatattgaaataa

SEQ ID NO: 416 - DNA, 549 bp, artificial sequence
  Nezara viridula
atggggaatatgtttgcaaatttgttcaaaggcctgtttggcaaaaaggaaatgagaatattgatggttggtcttgatgctgctggaaaaacaactattttatataaattgaaattaggagaaattgtaactacaatcccaactattggatttaatgttgaaactgttgaatataagaatattagtttcacagtttgggatgtaggtggtcaagacaaaattcgacccctttggcggcattatttccaaaatactcaggggctcatttttgttgtagacagtaacgatagggaacgtattggtgaagcgagggaagagctgatgagaatgcttgcagaagatgaattaagagatgcagttctgctaattttcgcaaacaagcaggacttgccaaacgctatgaacgcagctgagataacagacaagctgggcctacactcattgcgcaatcgcaactggtacatccaggcgacgtgcgcgacctcaggcgatggtctctacgaaggcctagattggttgtcgaaccaattgaagaatgccaaccgctag

SEQ ID NO: 417 - DNA, 384 bp, artificial sequence
  Nezara viridula
atgactgacgaagttaatcccaaagcttacccattagctgatgccaccctcactgctaagatattaaatgttgtgcagcaagctctcaactataagcagttaaggaaaggtgctaatgaatctacaaaaactttgaatcggggtttggccgagttcatagtgatggctgcggatgcagaaccattggaaatattgttgcatcttcctctgttatgtgaagacaagaatgtgccatatgtttttgtccgctccaagcaagctcttgggagagcgtgtggagtgtcccgcccggtcgtcgcctgctcggtgacgctcaacgaaggatctcagctcaagccgcagataacgaaaatacaacaagacattgagaggcttttagtgtaa

SEQ ID NO: 418 - DNA, 1302 bp, artificial sequence
  Nezara viridula
atgcctgattatcttggagatgatatgagaaaaactaaagaggagaaggaggaagaaaaggatattaaatctcttgatgaagctgatatcgctttacttaaaacttatggacaagggcaatacacgaaaagcatcaaaagtgtcgaagatgatattcagaccattatcaaacgtgtcaatgagctgacaggtattaaggaatcagatactggtttagctcctcctgcgttatgggacttggctgcagataagcagatacttcaaaatgaacagccgttacaggttgctagatgtacaaaaattatcaatgctgattccgaagatccaaaatacataataaatgtcaaacagtttgcaaaatttgtagttgacttagctgattctgtagcacctacagatattgaagaagggatgcgtgttggtgtcgatagaaataaatatcaaattcagatacctcttccaccaaaaatagatccaactgtaacaatgatgcaggttgaggaaaaaccggatgtcacttatagtgatgttggtggttgtaatgaacaaattgaaaaattgagagaagttgttgagactcctttgttacagcctgaaaagttcgtgaatttaggaatagagccaccaaaaggagttcttctttttggacctcctggtacaggaaaaacactttgtgcgagagctgttgctaacagaactgatgcctgttttatcagagtaattggttcagaacttgtccaaaaatatgtcggggagggtgcaaggatggtgcgtgagctatttgaaatggctagaagtaaaaaagcttgcctaattttctttgatgaaattgatgctattggtggtgccaggtttgatgatggagctggtggtgataacgaagttcaaagaacgatgttggaacttatcaatcagcttgatggttttgatcctagaggtaacattaaggttttgatggcaacaaatagacctgacactttggatcctgccttgatgaggcccggaagactggacaggaaagtggagtttggattgcctgatctagaaggtcgttctcatattttcaaaatccatgcacgctcgatgagtgtagagagggatattcgatttgagttacttgctcggctctgtcctaacagtacaggtgctgaaatcagatcagtgtgtactgaggctggaatgtttgctattcgagctcgaaggaaagttgctactgaaaaggatttcctggaagcagtgaataaagtgattaaatcttatgctaagttctcagccactccaagatatatgacatataattaa

SEQ ID NO: 419 - DNA, 444 bp, artificial sequence
  Nezara viridula
atgaagatgaacaagttggtgacctcttctaggaggaaaaatcgtaaacgtcattttactgctccatctcatattagaaggaaattgatgtcagctcctctctccaaggaactcaggcagaagtacaatgtccgcaccatgcctgttaggaaagatgatgaagttcaagtagttaggggacattataaaggacaacaggtaggcaaagttattcaggtctacagaaagaagtttgttatatacattgaaagaattcaaagagaaaaagcaaatggtgcaagtgtctatgttggcatccatccttccaaaacagttatagtgaaactgaaaattgacaaagataggaaagaaattttggatagaagatcaagaggaagagccctagcccttggcaaagacaaaggaaagtacaccgacgagaacacagcaatggatacatcttaa

SEQ ID NO: 420 - DNA, 2868 bp, artificial sequence
  Nezara viridula
atggctgtggtggaacaaccttgttataccctgattaattttccatcagatttagagcctcccaatgaaatgcagctaaaatccgatttagaaaatggagacactaaagcgaaaattgaagctttgaaaaatattattcatttgattgcaaatggagagcgtttacctggtttacttatgcatataatacgttttgttttgccatcacaagaccacaccattaaaaaattactccttatattttgggaaattgttcctaaaactactccagatggcaaacttcttcaggaaatgattttagtttgtgatgcctatcgaaaggacttacaacatcctaatgaatttgtcagaggatccacattacgctttctttgtaaacttaaagagcctgaattacttgaacctttaatgcctgctattagagcttgcttagagcatcgggtttcatatgttcgaagaaatgctgtacttgcaatatttaccatttataggaattttgaattcttagcacctgatgcaccagaactaattgctaatttcttagatggtgagcaagatatgtcatgtaaaagaaatgctttcttgatgctcctacatgctgaccaagaacgtgccttatcctatttggcttcatgtcttgatcaagtgaattcatttggtgacatacttcagttagttattgttgaattaatatataaggtttgccatgctaacccttcagaacgttctcgatttatacgctgtatttataatttactcaattctaatagtcctgctgttcgatatgaagctgctgggactttaattacgctttcgaatgctcctactgcagtaaaggctgcagcttcttgttacattgacttgataataaaggaaagtgacaataatgttaaattaattgtattagatcgtttaatatcactaaaagagattcctacacatgagagggttctgcaggatttagttatggatatattacgtgtgttagccagtcctgacatggaagtaaagaaaaaagcattaagtctagcactagatctcactacttcaaggtgtgttgaagaaatggttttaatgttgaaaaaagaagttgctaaaacccataatttgactgaacatgaagatgctggaaaatatcgtcaacttcttgttagaactctccattcctgttgtatgaagtttccagatgttgctgcttcagtaatacctgtattaatggaatttctctcagatacaagcgaactagcttcatatgatgtccttatatttgtccgagaagcaatccataagtttgattctttaagggctttgataatagagaaattattagaagcatttccaacaataaaatctatgaaagttcatcgagctgctctttggatattaggtgaatatactacttcagttacagatattaaagaagtcatgaaacaaataaaaaatgctcttggagagataccacttgttgatgatgaaataaaaagagcttctggagagaaagttgaggaagtagatcatcgtgatcaagtgaagcttgttacatctgatgggacgtatgctacacaatcaatatttaacaccattctttcaataaagaaagaggatcgaccacctcttagacagtacttaattgatggggacttttttattggtgtgtctgtggcttctacacttgtgaaattagccttacgttataaagagcttgttaaacaggaaaatatgtaccataaattttttgctgagtgtatgcttatcatttcatcaatagtacgtctgggtaaatcaggatatccatcaaaacagcttagctatgatgattacgaacgaatgttactttgtctaaaggttctttcagaaaataatgctcctattataaaaatttttaacaccgattgccgtaacgctctcgctaatatgttagttgcacaacagaatgaagagtattcacttataaaggctaaagaaaagtctgttcatactatccaagttgatgatcctgtatcatttttacaattatcaacaatgcgatcatctgattttggttctgaaaatgtttttgagcttagtctaaatcaagctgttggaggacctaatacagctgcaaacacaaccgagcttccattttctgccagtaaattgaataaagtaactcaactaactggattttcagatcctgtttatgctgaagcctatgttcacgtcaatcagtatgatatagtactcgatgttttgattgttaatcaaacaggcgatacactacaaaactgtacacttgaactggcaactcttggtgatctgaaacttgtcgaaaaacctcagccttgtgttctggctccttatgatttctgtaatattaaagcaaatgtaaaagttgcatctactgaaaatggaatcatatttggcaatattgtttatgatatcagtggtgctgcttctgacagaaatgttgtcgttcttaatgatatccatatagatatcatggattatattgttcctgctacttgttcagatacagaattccgtcagatgtgggctgaatttgaatgggaaaacaaagtgtctgttaatacgtatttggttgatcttcatgaatatcttggacatttattaaagagcaccaatatgaaatgtttaactccagaaaaagctctctgtggccaatgtggattcatggctgccaatatgtatgcccgttcaattttcggagaagatgcattagctaacttaagcattgaaaaaccatttaataagcctaatgcccctgttactggacatattaggatcagagctaaaagtcagggtatggcattgagcttaggagataaaattaatatgactcagaagaaacctactatcatggcccagtga

SEQ ID NO: 421 - DNA, 504 bp, artificial sequence
  Nezara viridula
atgccttttcagaggtttgttgaaacgggaagaatagcatatattgctgatggaccttaccagggcaagttatgtgctattgtggatgtaatcaatcagaccagggctttagttgatgggccagaaactggagtaccaagatgtggtataaggttaaaccaattgcatcttacaaagttcaggattcgtttcccttacaccgcttctacacgcgttgtccgaaaagcttggaaagacagcaatttggatgccaagtggaaggagagtgtttgggccaagaagttggaagccaaaaaaatcagagcaaatatgaatgacttcgacaggttccgccttaacaatgccaggagaaccaggagcaagatcactaccaatgccttcatgttgttgaaaaaacaagcaaagaaggccaagaaaaccgaagccaagcctggacagaagcctaaggacaaaaaacctgatgctaaaaaagcacctgctaagaaagcagagaaaaagaagtaa

SEQ ID NO: 422 - DNA, 5043 bp, artificial sequence
  Nezara viridula
atgtctcaaatattaccgatacgcttccaagaacatttacagctttcgagtgtaggaataaacccaactagtgtaggctttaacacattaaccatggaatctgacaagttcatatgcgttagagaaaaagttggagaaacttctcaagttgtgataatagatttaaatgataccgctaatccaataagaagacctatttcagcggattcagctatcatgaacccagctagtaaagttatagcattgaagggaaaagctggcactgatggaacaaccacccagaaaacattgcagatttttaatatcgaaatgagaagtaagatgaaagcacatactatgacagatgaagtagttttttggaaatggatatcccttaatacacttgcgttagtcactgaaacgtctgtttatcattggagcatggagggtgactctcaaccagtgaaaatgttcgatagacattctagcctgaatggttgtcaaattataaattacagaacagatcccaagcaaacctggcttttacttattggaatctctgctcagcataatcgtgttgttggagctatgcaattatattcagtagagcgcaaatgctcacagccgattgaaggacatgctgcatcatttgctcagttcaaaatggaaggaaaccctgacgtatctactttgttttgctttgcagttcgtacaccgacaggaggaaagcttcatataattgaggttggacagcccccctcaggaaaccagccattcgctaaaaaagcagttgatgtattttttccggtagaagcccaaaatgattttccagttgctatgcaggttagctctaagtatgatgtaatctatctaataacaaagtatggatatattcatctgtatgatttggaaacagctacatgcatttacatgaatcgtattagcattgatactatatttgtcactgcacctcatgaatcaactggaggtatcattggggtgaatagaaaaggccaggtgttatcagtgagtgttgaagaggaccacataatcccatatatcaataatatattacaaaatccagatctagccttacgcatggcagttagaaataatctagctggagctgaagatttgtttgttaaaaaattcaatatgcttttccagaatgggcagtatgctgaggctgctaaagtggcagccaatgctcccaagggaatactgagaaccccacaaaccattcagcagttccaacaaataccaaatccgcaagggcaaacatcacctcttttgcaatattttggaattttgcttgatcagggtcaattgaacaagtatgaatccttagaattatgcagacctgttctggctcaaggaagaaaacagttaatggaaaaatggctgaaagaagataaactagagtgctctgaagaactcggagatctagtaaaacaaacagacccaactcttgcactctctgtttatttaagagctaatgttccaaacaaggttatacaatgctttgctgaaactggacaattccagaagattgtactatatgcaaaaaaagtaggttattctcctgactacattttcctgctccgaaatgtaatgcgtgttaatcctgatcaaggtgttagctttgctcaaatgcttgttcaagatgaagaaccactggctgatataaaccagattgttgatatacttatggaacaaaatatggtgcagcagtgcactgcttttcttttagatgcccttaagaataatcggccttcagaaggtccattacagaccaggctacttgaaatgaatttgatttctgcacctcaggttgctgatgctatacttgggaaccaaatgtttacacattatgatagagcccacattgcccagctttgtgagaaggctggtttactccagagagcgttggaacattacacagatctttacgatattaaacgagctgttgttcacactcacctccttggccctgattggcttgtgggatactttggtaccctttctgttgaagattcacttgaatgtttgaaagccatgctaactgcaaatattcggcagaacttgaatatatgtgttcagattgctaccaagtaccatgaacaactaacaaccaaggctttaatagatctttttgaatcattcaaaagttatgagggattgttttatttccttggctcaatagtcaatttcagccaagatcaagaagttcattttaaatacatccaggcagcctgtaaaacagggcagataaaagaagttgaacgaatttgccgtgaatctaattgctataatccagagagagttaaaaattttttgaaggaagcaaagttgacagatcaattaccacttattattgtttgtgatcggtttgatttttgtcatgatttggttttatatttataccgaaacaatttgcaaaagtacattgaaatttatgtgcaaaaggtcaatccatctcggttgccagttgtgataggaggattattagatgttgattgttctgaagacataattaaaaatttgatgatggttgttagaggtcaattttcaactgaggagcttgttgcagaagtagaaaagcgaaatcgattaaaacttctgcttccttggctggaaactcgtgttcatgaaggctgtgttgagcctgctactcataacgctttagcaaagatatacattgatagcaataataatccagaacgattcttgagggaaaatcagtattatgatagctgtgttgtaggaaagtactgtgaaaaacgagatccacatttggcatgtgtagcctatgaaagaggtcaatgtgatagagagctcatcaatgtctgtaatgaaaattctctctttaaatcagaagcaaggtacttggttagacgtaaagaccctgaattgtgggctgaagttcttaatgaaaacaatccttacaagagaccattaattgatcaggttgttcaaacagctctttcggaaactcaagatcctgaagatatcagtgtgactgtcaaagctttcatgacagctgatttacccaatgaacttattgaactcctagaaaaaatagttctagacaattcaatatttagtgatcaccgcaatcttcaaaatcttctcattcttactgctataaaagctgaccgttcaagagtgatggaatacattaaccgtttagataattatgatgcacctgatatagcaaatattgctataaattatcaattatatgaagaagcatttgcaatatttaaaaagttcgacgttaatacttctgctatccaggttctaattgaaaatgtgaacaatctcgatagagcctatgaattcgcagaacgctgtaacgagccagctgtgtggagtcaattagccaaagctcaactgcaacatggccttgtaaaagaagcaatagattcattcataaaagctgacgacccttctgcatatgttgatgtggtggaaacagctcacaaaacagaaagctgggaggatttagtccgctatttacaaatggcaaggaaaaaggctagagaatcttacattgaaagtgagctgatttatgcttatgctcgcactaaccgattggctgatcttgaagaatttatctcaggtccgaatcatgctgatattcaaaagattggtgataggtgttttgatgacaagatgtatgaaccagctaaactgctttacaacaatgtttcaaactttgctagactagctataacactagttcatttaaaagaatttcaaggagctgtggacagtgcaaggaaagccaacagtacaagaacttggaaagaagtctgttttgcttgtgtggatagtgaggaattcagattagctcagatgtgtggtttgcatattgtggttcacgcagatgaacttgaagacctaatcaattattatcaggaccgaggatactttgaagagcttatcaatttattggaagctgcactggggttagagcgtgctcatatgggaatgttcacagaattagctatactctattccaagtataaaccagcaaaaatgagggaacatttagaattattttggtctcgagttaatattcccaaggtcttgagagctgctgaacaagctcatttatgggcagaacttgtttttctgtatgataagtatgaagagtatgataatgctgtgtctgcaatgatgaatcaccctactgaggcttggagagaaggacattttaaggacataattaccaaggttgccaacattgaactatattacaaagcaatacaattttatttggattataaacctctcctattgaatgatatgttattggtattagccccaagaatggatcatacaagagcagtaaacttctttgccaaggttaaccatttacaattggttaagccttatcttcgctcagtacaatcattaaacaataaagcaataaatgaagctctaaacaatcttctcattgaagaggaagacttccagggtgtcagaacatcaatagatgcttttgataatttcgacaatattgtattagctcaaaagcttgaaaagcatgagttgatcgaattcaggaggatagcagcttatctatataaaggaaataaccgatggaagcagagtgttcagttatgcaagaaagatagattgttcaaggatgcaatggagtatgctgcagaatcaaagaactcagaagttgccgaagaacttttagcatggttcttagaaaaaggaaatcatgactgttttgctgcttgtctgttccaatgttatgatcttcttcatcctgatgttattctagaacttgcatggcgacataatatcatggacttcgccatgccttatatcattcaagtgacaagagagtacatttccaaggttgataaattggaagaatctgaagcaagaaggttagaagaaagagcagaacaggatcacaaacctatgatgatgcctgagccacagctaatgttaactgctggcccaggaatgatcggacctggtttttcacctgcttatcctaacacttttaccactggcatgccttatcaaggttatggcatgtag

SEQ ID NO: 423 - DNA, 471 bp, artificial sequence
  Nezara viridula
atgcagattttcgttaaaaccctcacgggtaagaccattacccttgaggtcgagccttctgatactattgaaaatgtgaaagctaaaattcaagataaggaaggtattcctcctgatcagcagcgtttgattttcgctggcaaacagttggaagatggcagaactctgtctgactacaacattcagaaagaatctaccttgcacttagtgctaaggcttaggggaggtgcaaagaaacgtaagaagaagaattactccactcccaagaagatcaagcacaagaagaagaaggtcaaactagctgtgcttaaatattacaaggttgatgagaatggtaaaatcagcaggttgaggagggagtgtccctctgaacagtgcggtgctggtgtcttcatggctgccatggaggacaggcactactgtggaaagtgtgcatacacccttgtcttcaataagcctgaagataaataa

SEQ ID NO: 424 - DNA, 582 bp, artificial sequence
  Nezara viridula
atggtcaatcggagggttccgtctgtgcatagtaaaacctatgtcacaccaaggcgtccttatgaaaaggctcgtctagaccaggagttgaggattattggagaatatgggcttagaaacaagcgtgaagtatggagggtcaaatatacccttgctaaaatcaggaaagctgcccgagaacttcttactcttgatgagaaggatcctaagaggttgttcgaaggtaatgcacttttgaggagattagtaagaattggagtattagatgaggctaagatgaaacttgattacgttttgggtcttaaagttgaagatttcttggaaaggaggcttcagactcaggttttcaaattgggtcttgctaaatcaattcaccatgctagggttttgattaggcagaggcacattagagtgaggaagcaggttgtcaacatccccagctttattgtgaggttggactcacagaaacacattgacttctcactgaagtctccattcggtggtggccgccctggccgtgtaaagaggaagaactcccgcaagggaaccaccgctgccgctgcagaagaagacgaagattaa

SEQ ID NO: 425 - DNA, 834 bp, artificial sequence
  Nezara viridula
atggcaggagtcttagccactgagagaactcttcctgggttttcttttgaaaattgtcgaaggaactccctcttgttgcagcaaggatttaaaccgcccactgcgcagaagactggtacaacaattgttggaataatttatagagatggggttattcttggagctgatactagagctacagaaggtagcacagttgctgacaagaattgttccaagatacattttctagctgacaacatttattgctgtggtgctggtactgctgctgatacagaaatgacgaccatgacaatcatgtcacaattggaattacatcgtctcaatactggtcgccctgtcagagtttctacagcaaagcagcttttgaaacagttactcttcaggtatcagggccacattggagcagctcttgttgttggtggggtcgatgtgactggacctcttctttattctatacatcctcatggctcctcagaatgcttacccttcacaactatgggttctgggtctcttgctgctatgacagtacttgagtcatcatggaagcctgatttatctgaagaagaaggtaaagtaatagtccgcaatgctattgctgctggaatatttaatgatcttggttcagggagcaatgtagacatttgtatcatccggaaaggttctgttgattatatccgtccctttgatgttgccaatctcaaaggacaaaagcaaaataattatcgttttcggcgaggaactacgggagttctttcaacaaggataattcctttggtgacagagtcagaagaaataaaaaaaactgaagtggaatccatggatacatctgcttga

SEQ ID NO: 426 - DNA, 759 bp, artificial sequence
  Nezara viridula
aagagagcaaggatagtgactctcaccaggttattgtacttttgcttggtaatcatgggttctgagagatacagtttttctctgactacatttagtccttctgggaaattagttcaaattgagtatgctcttgctgcagtcgcagctggagctccatcaattggtatcagagcatctaatggggttgtattggctactgaaaacaaatacaaatcaattttatatgaagaacatactattcaaaaagtagaaatgataactaagcacataggaatggtctacagtggtatgggacctgattatagattacttgttaagagagcaagaaaaatggcgcagcaatatcagttagtttatggcgagcctattcctaccgcacaacttgtccaacgagtagctatggttatgcaggagtacactcagtcaggaggtgtgagaccgtttggagtttctttactcatcgctggctgggatggagataaaccttctctatttcagtgtgatccatctggagcatactttgcctggaaagcgactgctatgggaaagaattttgttacaggcaaaacttttctagaaaagaggtacagtgaaactttggagctagatgatgcagtacatacggcaattcttactctcaaggaaaacttcgaaggacaaatgacttcggacaatatcgaggttggagtttgcgatgcccaaggcttcagagttttagacccaactactgtcaaggattatcttgctaatattccataa

SEQ ID NO: 427 - DNA, 786 bp, artificial sequence
  Nezara viridula
gcaactgcttctaaggcagctccagcaccagctgctaaagcagctgcagccaagtcagccgcccccagttctgctaagccagcttcagccaagcaacccgccccagctcctaaagctgcacagcctaaagcccaggctaagcctgcagctcaacaacagaaaccagctaaaccacaacagcaagggaaagctgcagccccagcgaaagcacaagctaaacctgcagcgcaggccaagcctgctgctccagccgcagctcccaaacaaccagccgctccagcagcagcagctggaacccaaccagccgctgcagcacccaagaaagctccatcaggtgcagttaagaaagcagcaactgcccctaagaaaagtcaaaatttacagaaaaaatctcaccaaggtgttaggaaacaagtgttaaaaggaaaaggacaaaaaaagaaaaaagtctcattaaagtttataattgactgtactcatccctatgaggacaaaatcatggatgtcgccaactttgaaaagtatattcaggagaggtttaaagttaatggtaaaaccaacaacttaggcaacaatgttactttagaaaggaacaagatgaagataactgttacttctgatgtacattttcccaaaaggtatttgaaatatttgactaagaggtaccttaagaagaacaatctgagggattggctcagggttgtatcaagttctaaagacacctatgaactaaggtacttccagttcaacagccaggatgatgatgatgaagaggacaatgattaa

SEQ ID NO: 428 - DNA, 351 bp, artificial sequence
  Nezara viridula
atgactaagaaaaggaggaatggaggaagatcaaaacatggcaggggtcatgtccaagcagtgcgttgtaccaactgtgctcgttgtgttcctaaggataaggctattaagaaatttgttattcgtaacatagttgaagctgctgctgtgagggatatcacagacgctagcgtatactcctcataccaattgccgaagctctatgctaaactgcattattgtgtatcatgcgctatccactctaaagtagtgcgtaatcgttctaaggctgagagaagaattaggacacctcctcagcgaaacttcccaagggatatgatgcgccaaggtggaccccaaataaggaagtaa

SEQ ID NO: 429 - DNA, 900 bp, artificial sequence
  Nezara viridula
atgggtttcgttaaagtcgtgaaaaataaacaatactacaaaaggtttcaagttaaatttaagaggcgacgagaaggtaaaacagattattatgccaggaagagattaattgtacaggataaaaataagtacaatactcctaaatatcgtttgattgtccgcctttccaacaaagacataacatgtcaggttgcttattctcgcattgaaggtgataaaatattgtgtgctgcatacagccatgaacttcctcattttggaattaaagtaggattaaccaactatgctgctgcctactgtactggtcttcttttggcaaggaggcttcttcaaaaactgaagttggatggtttgtatgaaggtacaaccgaagtaacaggtgatgagtacaatgtagagaatttagatgaaggtccaggtgctttccgctgttacttagatgttggtttaatgaagaccagtgctggagcccgtgtttttggagcactgaaaggtgccgttgatggaggtcttaacatccctcatagcatgaaaagatttccaggttatgattctgaaagcaaagagttcaatgctgaagtgcacagaaaacacatttttggaattcacgttgctgaatatatgaggcagttgtccgaatctgacgaagaagcttataagaagcagttcagtgtttacatcaaaaatggcattgttcctgatgctattgaagacatttacaagaaggcacatgctgcaatcagggaaaatcctgccccaagaccacgtgtaaggagtaaggagcccatcaagaagagatggaatcgtgctaaacttactcttgcagaaagaaagaattgtattgcccaaaagaaagcagcattcttaaagaaaatacaggccggcgatgtcgatgcctaa

SEQ ID NO: 430 - DNA, 1710 bp, artificial sequence
  Nezara viridula
atgcaaatttttgttaagacccttacaggaaagaccattactcttgaagttgaaccatctgatacaattgaaaatgtcaaagctaaaattcaggataaggaaggaattcccccagatcaacaaagattaatctttgctggtaaacagttggaagatggccgcaccctttctgattacaatattcagaaggaatctactcttcatttggtcttgcgtttgagaggtggaatgcaaatttttgttaaaactctaactggaaagactatcaccttggaagttgaaccatctgataccattgagaatgttaaggccaaaattcaggataaagaaggaattcctccagatcagcaaaggcttatttttgctggaaaacaactagaagatggccgcactctgtcagattacaacattcagaaagaatccaccctgcatcttgtacttcgtttaagaggaggaatgcaaatttttgtcaaaaccttaactggaaagaccatcacattagaagtggaaccatctgacacaattgaaaatgtcaaagctaaaattcaagataaagaaggcatccctccagaccaacaaagattgatttttgcaggaaagcaattagaagatggtcgtactttatcagattataacatccagaaagaatctacactgcatttagttctacgtttacgtggaggaatgcaaatttttgtcaagactctaactggaaaaactatcactcttgaagttgagccttcagatactattgagaatgttaaagctaaaattcaggataaagaaggaattccgccagatcagcaaagactgatctttgctggaaaacagttggaagatggccgtacgctttctgattacaatatccaaaaggaatccacattgcatcttgttcttagacttcgaggaggtatgcagatctttgtgaagacattaacaggaaagactatcaccttagaagtagaaccatctgatactattgaaaatgtaaaggcaaagattcaggacaaagaaggaattcccccagatcagcagagattaatttttgctggaaagcagcttgaagatggccgtactctttcagattacaacatccagaaggaatctacgttacatctagtccttcgtctgcgaggtggtatgcagatttttgtaaaaactctgacagggaaaaccattactttagaagttgaaccatcagatactattgagaatgtcaaagcaaaaattcaagataaagaaggaattcccccagaccaacagagattgatttttgctggcaaacaactcgaagatggcagaactttgtctgattacaacatccagaaagaatcaaccctgcatctagtactacgtttaagaggaggcatgcagatttttgtcaagacactcactggaaagactatcactctagaagttgaaccatctgatactattgaaaacgttaaggctaaaatccaagacaaagaaggaattccaccagaccaacaaaggcttattttcgctggaaaacagcttgaagatggcagaactttgtctgattataacatccagaaagaatcaaccctacatttagtattgcgtctgcgaggaggtatgcagatttttgtcaaaaccttgactggtaaaaccatcaccctggaagtagagccttcagatactattgagaatgttaaagctaaaattcaggataaagaaggtattccacca

SEQ ID NO: 431 - DNA, 615 bp, artificial sequence
  Nezara viridula
atggcggatgatgaagcaaagaaggcaaaacaggccgagattgagcggaagagagcagaggtccgaaagaggatggaggaggcctcaagaggcaagaaggccaagaaaggtttcatgacgccagacaggaagaagaaactccgacttctgctgagaaagaaagctgctgaagaactgaagaaagaacaggaaaggaaagcagccgagagaaggaggatcattgaggagcgctgtggaaagatttgtgacgttgacaacgccagtgaagaaaaattgaagaaaatctgctctgattaccaccagcgaattggacggttggaggatgaaaaatttgacttggaatacgttgtaaaaaagaaagattttgagattgcggatcttaacagccaagtcaatgatcttcgtggaaagttcgttaaacccaccttgaaaaaggtttccaaatatgaaaataaatttgccaaacttcagaagaaggctgctgaattcaacttcagaaatcaactcaaagttgtgaagaagaaggaatttaccctagaagaagaagacaaagagaaaaaaggaggcatcgtcgactggtccaagaaggatgaaaaggcaaaggtagaagcatga

SEQ ID NO: 432 - RNA, 354 nt, Piezodorus guildinii
auggcgcccaaggcucccaaauaugaaauggccguuggccuuaagaaaggucacaggacaacuaaaauuguuaugggaaaguccaaagcugacaaaaaacauaaaaucaggccaucucgucuaaaagguagacaaaccaagcacacuaaauuugugcgagacuugaucagagaaguuuguggucaugcaccuuaugaaaagagaggaauggaauugcucaagauuucuaaggauaagagggcuuugaaauucuugaagagaaggaucggcacacacauccgugcuaagaggaagagggaagaacucagcaacauccuuacccagaugcguaaggcucaugcccaacaaaaauaa

SEQ ID NO: 433 - RNA, 681 nt, Piezodorus guildinii
augucucuuagcgacgcagauguacaaaaacaaauuaagcacaugauggccuucauugagcaggaggccaaugaaaaggcugaagaaaucgaucaaaaagcugaagaagaauucaauauugagaaaggucggcuuguucagaaucaaagauuaaagauaauggaauauuaugaaagaaaagaaaaacaggucgaacuacaaaagaaaauccaaucuucaaauauguugaaccaagcucgacugaaagcuuugaaaauucgugaagaucaugugcgugaugugcucgaugaggccaggaagagacucuugcaaucagucaaagaugaggcucguuacaaagacauucuucagaaacuuaugcuucagggacuguuccaguugauggaaucagacauuuugguuagaacucgugaaacggauggcccaguugucagcucaguguuuccugaugugcuggucaaauacaaggaagcaucagguaaggauuugcaacuuaaguuggauacagagucguacuuaccaucugaaugugcuggcgguauugaacuauacacugcuagagggcguaucaagauuguuaauacucuugaauccaggcucgaucuuauuucagcccaguuauugccccagaucagaacaucucuauucggucgcaaugcaaaccguaaauucgcugacuaa

SEQ ID NO: 434 - RNA, 357 nt, Piezodorus guildinii
auggccagucagacucaaggaauucagcaguuauuggcggcugagaaaagagcugcagaaaaaguugcugaggcgaaaaaacgcaaggcaaggcgccucaagcaagcuaaagaagaggcccaagaagaaauugagagguacaagcaagauagagaaaaacaguucagagaauuugaagcucagcauaugggaucucgagaagacguugcagcaaggauagaugcugauacccgccaaaagauugaggaaaugaaugaagcaguaaaugccaacaaagaagcgguuauucaaagaauuuuggaauugguuuaugauaucagaccugagaugcauaagaacuacagagcaccaaauuaa

SEQ ID NO: 435 - RNA, 1293 nt, Piezodorus guildinii
augucuacaucaaaaacagaagaaaaaccuaugugggaugaaaggauggaacaagcauuaggugaagaaauuaugagaaugucuacugaugaaauuguaagccguauuagacuucuugacaaugaaaucaaaaucaugaaaagcgaaguuaugcgagugagucaugaguugcaagcacaaacagaaaaaauaaaagaaaacacagaaaaaauuaaaguuaauaaaaccuuaccauacuugguuucaaaugugaucgaguugcuugacguagauccagaggagacugaagaagauggugcuguuguagaccuugaugcucggcguaaaggaaaaugugccgucauaaaaacaucaaccagacaaacuuauuuuuugccagucauuggcuuaguugaugcagaaaaauuaaagccaggugaccuuguuggagugaauaaagauucuuauuugauucuugaaacuuugccugcagaauaugaugcaagagucaaagcuauggaaguugaugaaagacccacugaacaguauucugauauugguggacuagacaagcagauucaagaacuaaucgaagcuguuguucuuccuaugacccacaaagaaaaguuugaaaaucuuggaauucauccuccuaaagguguacuacuuuauggaccuccuggaacaggaaaaacauuauuggccagggcgugugcagcucaaacaaaaucaacuuuuuugaaacuagcugguccucagcuuguacaaauguucauuggggauggagcuaaacuuguuagagaugccuuugcucuugcuaaggaaaaaucuccagcaauuauauuuauugaugaauuagaugcuauugggacuaagagauuugauuccgaaaaggcuggagaucgagaaguucaaagaacuauguuagaguuacucaaccaguuagauggcuuuagcucaacugcugacauaaagguuauugcugcaacaaacagaguagauauuuuagauccugcccuuuugcguucaggaagacuggauagaaaaaucgaauucccucacccuaacgaagaugccagagcacguauaaugcaaauucauucccguaaaaugaacauuaguguugauguuaauuuugaagaacuugcucguucaacagaugauuucaauggugcucaguguaaagcuguuuguguagaagcagguaugauagcuuugcguagaggagcuggaguaguuacucaugaagauuuuauggaugcaauauuagaaguucaagcaaagaaaaaagcuaacuuaaacuacuaugcuuag

SEQ ID NO: 436 - RNA, 387 nt, Piezodorus guildinii
augcagaucuucguuaaaacccuuacggguaaaaccauuacccuagagguugaaccuucugauacuaucgaaaauguaaaagcuaaaauucaagacaaagaaggaauuccuccagaucaacaaaggcuuauuuuugcuggcaaacaguuggaagauggaagaacauuaucugauuacaacauucagaaagaaucuacucuucacuuggugcuucgucuuagggguggugucauugaaccaacucugaagauccuugcccagaaauacaauugugauaaaaugauuugccgcaagugcuaugcuagacuucacccaagagcaacuaacugccgcaagaagaaauguggucauaccaacaacauccgccccaagaagaagcugaaguag

SEQ ID NO: 437 - RNA, 1188 nt, Piezodorus guildinii
augacggcuucucaagcaauggaaccaaacagagaaaaagcuuuacaagauuaucguaaaaaauuacuagagcauaaggaaguagaaguuagacuuaaagaaaugagagaccaguuaaaagaucuuacuaaacaguaugauaaaucugaaaaugauuuaaaagcccuccaaaguguuggccagauugucggagaaguuuugaagcagcuuacugaagaaaaauuuauuguaaaggcuacaaacggcccaagauacguuguugguuguaggcgacaacuggauaaguugaaacugaaaucugguacucgaguagcauuggauaugacaacacuaacuauaaugagacacuuacccagggaaguugauccauuaguguauaacaugucucaugaagacccaggagaugucacauauucugcuauuggaggucuugcggaacaaauuagggaacuucgugaggugaucgagcugccucuauugaauccagaacuuuuucaacguguugggaucacuccccccaaaggaugucuacuuuaugggccuccugguacuggaaagacuuuauuggcuagagcuguugccagccaauuagaugcuaauuuccugaagguuguuuccagugccauuguugacaaguauauuggugaaagugcucgucugaucagagaaauguuuaauuaugcaagggaucaucagccuugcauaauuuuuauggaugaaauugaugcuauugguggucgaagauucucagaagguacaucugcugaucgugaaauucaaagaacccuuauggaacuucuuaaccaaauggauggauuugauucauuaggacagguaaaaaugaucauggccacuaaucggcccgacacccuugacccagcucuccuccgucccgguagguuagacaggaagauugaaauaccacugccaaaugaacaggccaggcuagagauccucaagauccacgcuaguccuauuucgaagcauggagauauugauuacgaggcuguugugaaguugucugauaauuucaauggagcugauuugagaaauguuuguacugaagcuggucuuuuugcuauucgagcugaaagggaauauguaaugcaggaagauuuuaugaaagccgugaggaaaguggcugacaacaagaaacuggagucaaaacuugauuacaagccaguauaa

SEQ ID NO: 438 - RNA, 1254 nt, Piezodorus guildinii
auggcgggugcaauguuguuugagaggacugucucuucuagagauagggauaauagucgaauucuuccuacuucuagcagaaaugucgacgaugacaaugacgaagaagacaucagaaauaaggaacaagggauuuugcaguugggagagcaauacaagaaagaggguaaagcuaaagaguuagcagaacuuaucaaggcaaguagacccuuucuuagucaaauaagcaaagcuaaagcugcgaaauuggugcguucuuuaguggauuauuucuuggaucuugaagcugggauaggaauagaaguucaacuuuguaaagaguguauagaaugggcaaaagaugaacacaggacuuuccucaggcagucacuggaagccaggcuuauugcucuauauuucgacacuggaauguucacagaagcacuccagcucggcucaagucuccuuaaggaauugaagaaguuagaugauaaaaauuugcuuguugaaguucuuuuguuggaauccaaaacuuaucaugcuuugaguaaucuuucuaaagcccgggcugcucugacaucggccaggacaacugcuaauucaauuuauuguccaccuaaaaugcaagcagcccucgauuugcagucugguauauuacacgcagcugacgaacaggauuucaaaacagcuuacucauacuuuuaugaagcauuugaagguuaugauaguguugacagcccgaaggcuuugguagcucuuaaguacaugcuuuugaguaaaaucauguugaauacgccagaagaugugcagcaacuaguuaguggaaaacuugcucuuaaacacgcugguaaagauaucgaugcaaugaaaucaguugcucaagcuagccauaagagaucccuugccgauuuucagauaacuuuaaagaauuacaagaaagagcuggaagaggauccgaucguaagagcucacuuggguacacuuuacgacaacauguuggaacagaauuuguguaggaucauugagccguauucaagaguucaggucgauuuuauuucaaaaucgaucaagcuuccccuuccucaagucgaaaagaagcuuucucagaugauucuugacaagaaguucaacggaauucucgaccaaggugaaggaguucuaauaguguuugaagaugcagucguugaaaaaaccuacgaaauggcuuuagaagucauuaacaguauggguaaggucguagacacauuauaucaaaaagcuaagaagcucucauaa

SEQ ID NO: 439 - RNA, 480 nt, Piezodorus guildinii
augacgaacuccaaggguuaucggcgagguacccgugacuuguuuucacguggauaccggaaacauggugucauuccacuuucgacuuacaugaaagucuauaaaguuggagacaucguaucaauuaaggguaauggagccguucaaaaagguaugccccacaaaaguuaucauggcaaaacaggacgaguuuacaauguuacucccagagcuuugggugugaucgucaacaaaaggguccguggaaaaauucuacccaagaggaucaacauccguauugagcacgucaaccacuccaaaugccgugaagauuucuugaagcguguccgagaaaaugaaaggcugaggaaggaggccaaagaaaaggguauucgaguugaauugaaaagacagccugcccagccacgaccugcucauuugauaacugucaaggagccuccaaucaugcuugcucccauaccuuaugaauuuauugcuuaa

SEQ ID NO: 440 - RNA, 600 nt, Piezodorus guildinii
augaguucauugaagcuacagaagaggcuagcagccucuguuaugaggugugguaaaaaaaagguuugguuagauccuaaugaaauuaaugaaaucgccaacaccaacucaagacaaaacaucaggaaguuaauaaaagaugguuuuaucaucaagaaaccuguugcaguacauucuagagcccguguccguaaaaauacugaagccagaaggaaagguaggcauuguggcuuugguaaaaggaaagguacugcuaaugcaagaaugccagcaaagguuuugugggugaacagaaugaggguucuuaggcgguuauuaaagaaguauagggaagccaaaaaaauugacaggcagauguaucaugacuuauacaugaaagcuaaagguaacguuuucaaaaacaagcguguacuuauggaauucauucacaagaagaaggcugaaaaagcuaggucuaagaugcuucgugaucaagcugaagccaggaggcagaagguuaaagaagcuaagaagcgacgagaagaaaggaucacauuaaagaaacaagaaauuuuacaauccuaccagagggaagaugaagcugccacugcuaaaaaauaa

SEQ ID NO: 441 - RNA, 786 nt, Piezodorus guildinii
auggugaugaauuuguuuauagcgacgggccauaugggcuuguuucgucgguugcuuaucagcuguucacagccuucauuaucggaagcagcgccgauacagccagccuuggcaaaguauccagaaagcucuucgcucacguuaccguguuucccaaagccuucauuuacaaugggggcuuacaaguacauucaggaacuguacagaaaaaagcagucagaugccaugcgguaucugcugcguaucaggguuuggcaauaccgacagaugaccaagaugcaccgcgucgugaagccaucaaggccagacaaagccagaagauugggauuuaagaauaagcaagguuucugcaucuucaggauccguaucaagaggggagguaggaaacgcccagucccaaagggugccaccuacggcaaaccuaaaagccauggagucaaccagcucaagccuacaaggagucuucacgccauggcugaggagaaaguugguaggaggugcagcggauugaggguacucaacuccuauugggucgcccaagacgcuagguacaaguacuaugaggucaucugcauugacccggcucacaaggcuaucagaagagacgcuaaggccaacuggauaugcgacccagugcacaagcaccgugagaugcgcggcaagaccagcgccgccaggaagucucgaggcuugggcaagggccacagguacucucagacuaagggagguuccaggaaggcugccugggugagaaggaacacacuccagcugaggagaaagcgauaa

SEQ ID NO: 442 - RNA, 1131 nt, Piezodorus guildinii
augugugacgacgauguugcugcccucguaguugacaaugguuccgggaugugcaaggccggcuucgccggagacgacgccccgagggccgucuuccccuccaucgucggcagacccaggcaccagggugucauggucgguaugggccaaaaggacagcuacguaggagaugaagcccaaagcaagagagguauccugacccugaaguaccccauugaacacgguaucaucaccaacugggacgacauggaaaagaucuggcaucacaccuucuacaacgagcugcgagucgcuccagaggaacaccccauccuccucacugaggcuccccucaaccccaaagcuaacagggagaagaugacccagaucauguuugagaccuucaacaccccagccauguaugucgccauccaggcuguacucucccucuacgccuccggucguaccaccgguauuguacuugacucaggagauggugucucccacaccguacccaucuaugaagguuaugcccuuccccacgccauccuccgucuggaucuugcuggacgugacuugacugacuaucuuaugaagauccucaccgagcgugguuacagcuucacuaccaccgcugaaagggaaauugucagggacaucaaggaaaaacugugcuaugucgcccuggacuuugagcaggaaauggccaccgcugccgccuccaccucccucgagaaguccuaugaacuucccgacggucaggucaucaccaucgguaacgagagguuccguugcccagaggcucucuuccagccuuccuucuuggguauggaaucuugcgguauccaugagacugucuacaacuccaucaugaagugcgauguugacaucaggaaggaccuguacgccaacacuguccuuuccggagguaccaccauguacccagguauugcugacaggaugcagaaggaaaucaccgcccucgcuccuucaaccaucaagaucaagaucaucgcucccccagaaaggaaguacuccguauggaucggagguuccaucuuggccucccuguccaccuuccagcagauguggaucuccaagcaggaauacgacgaauccggcccaggcaucguccaccgcaaaugcuucuaa

SEQ ID NO: 443 - RNA, 1518 nt, Piezodorus guildinii
auggugcuaaucgcagcagcgguuugcacaaaagcugguaaaacaaucguuucgaggcaguuugucgaaaugacuaaggcccgcaucgaaggauuguuagcagcauuuccaaaguugaugucaucggguaaacaacauacauuuguugaaacugauucaguucgguauguauaucagccccuggagaaacuuuacauggugcugauaacuacuaaggccucaaauauuuuagaagaucuugaaacacuaagacuguucucccguguaauuccugaauauugccgcaauauggaagagucagaaauuacugaaaaugcguuuaauuugaucuucgcauuugaugaaauuguggcucuugguuacagggaaaguguuaacuuagcucagauuaggacuuaugucgaaauggauucucaugaagaaaaaguauacauggcuguaagacagucgcaagagagagaagccaaaaauaaaaugagggaaaaagccaaagagcugcagagacaaagguuagaagccgguaagaaaggcuacaaaacuccaaguauugcuggauuugguucaucaucaacauacacaaguccaguuguugaaacugucgaucugccuaaaccuucauauacaccugcgaaaccugucuuaucagcaaaagcuaugaaacuuggugguaaaucaagagauguugaaucauuuguugaucaacugaaaucugagggagaaaauguuaucucacaaguagcuguaaauaagccuguugcggccaaguuagcuucuucgccaaauauucacauggaagagguccaucugaagcaggaagaaaagcugaugguuucuguuggaaaggaugguggaauacagagcuucgagcuccauggccuuguaacuuuacggauaacugaugaaaaauaugcaaagauaaaaguauaucuugacaauaaagauaagagaggaauucaguugcagacacauccuaauguggauaaagaauuguucaaacugaaaucucagauagguuugaagaauccuucaaaaccauuucccuuaggaacugauguagguguacuuaaauggcgguaccaaucucaagaugaaucugcacuuccucuuacuauuaauuguuggccaucagaaaauggacaaggagggugugaugucaauauugaguaugaacuugaacaugcucaucuugaacuaaaugauguuaccaucaacauuccauuaccuauugggugcucucccguuguugcugagugugauggugaguacaagcaugagucccgaaggaacuugcuccaguggguucugccaguuauagacaggaguaacaaaucgggagcgauggaguuuucggcaucuucagccaugccuucugacuuuuucccuuugauaguaucguucaccucaaaacagcccuaugcagaucuaaaggcuguugaaguucuucauguugaugaugaaacuccuguaaaguuuucaagugaaacauuguuuuauacagaaagguaugaaauuguauaa

SEQ ID NO: 444 - RNA, 1188 nt, Piezodorus guildinii
uaugaugguccaccagggauggacccugaaggaaucaucgaguccaauugggaugagguuguugacaauuuugaugauaugaaccucaaagaagaacuucucagaggaauuuaugcuuaugguuuugaaaaaccuucugcuauucagcaacgggcaauuauaccguguguuagaggacaugauguuauugcccaagcacagucagguacugguaagacagcuacauucuccauuucuauauuacaacaaauugacacuagugcaagagaaugccaggcuuugauauuagccccaacacgugaauuagcucaacagauucagaaaguaguuauagccuugggagauuucaugggagccaugugccaugcaugcauuggugguacaaaugugagagaagacaugcguaaauuagaaaugggagugcauguuuuaguuggaacuccaggacgaguuuuggauaugauuagccgcagggcucuaaaaacaaauacuauuagaauuuuuguguuggaugaagcugaugagaugcuuucucgugguuucaaagaucagauccaugauguauuuaaaaauuugaaucaugaaguacagguuauauugcuuucagcuacuaugccaucagauguauuggaugucaguacaugcuucaugaggaauccuauucguaucuuaguuaaaaaggaagaacuuaccuuggaagguaucaaacaguuuuuuguauuuguugagagggaagaguggaaguuggauacucuuugugauuuguaugaaacucuaaguauuacccaagcuguaauuuucuguaauacaaggcguaaggucgauuggcugacugagaacaugcauaauagagacuucacuguuucugcuaugcauggagauauggagcaaagagagcgagauauaauuaugcggcaguuccguacugguuccagcagaguuuugaucacuacugaccuuuuggcuagaggcauugaugugcagcaaguuucucuugucaucaauuaugaucuuccaucaaauagagaaaauuauauucacaggauuggaagagguggccgauucggucguaaagguguggcgauuaacuuuguaacagaagaggacaaacgcucucuuaaugauauugaacaguucuacaauacccguaucgaagaaaugccuaugaauguugccgaccucauuuaa

SEQ ID NO: 445 - RNA, 792 nt, Piezodorus guildinii
auggcucguggucccaaaaaacauuugaagcguuuaaaugcuccuaagucauggauguuggacaagcuuggugguguuuuugcccccagacccagcucugguccacacaaacugagggaauccuugcccuuagucauuuuccuucguaacagacuaaaguaugcucugaccaauacugaagugacaaaaauuguaaugcaaagguugaucaaaauugaugguaaaguuaggacagacccuaacuauccugcugguuucauggaugugaucagcauugagaaaacuggugaauuuuuccgguuaauuuaugacguuaaaggacguuaugccauucauaggauuacuggugaugaagccaaguacaagcuguguaaaguuaaaagagugcagacuggaccuaaggguauaccuuauuuagugacacacgacgcuagaaccaucagguacccagauccacuugucaaaguccaugacaccauucagcuugauauugccacuggcaaaaucauugauaucauccgaauggagucagguaaucuuugcaugauuacugguggccguaacuugggaagaguaggaacuguagugaacagggagagacauccugguucuuuugauauuguccauauuaaggaugcuaguggacauaccuuugccacacgauugaacaauguguucauuauuggaaagggcagcaaagcauacguuucauuaccuaagggcaagggugugaagcucaguauugcugaagaaagagauaagaggcuugccgcaaagggugcauccagcuaa

SEQ ID NO: 446 - RNA, 2409 nt, Piezodorus guildinii
auggcugauaugaaaagcaaugaagauuugucaacugcaauccugaaaaagaaagauagaccaaacagauugauuguggaagaugcagucaaugaugacaauucuguuguugcucucucacaggccaaaauggaugaacuucaguuauuucguggagauacugugcagcuuaaagggaaaagaaggaaggaaacuguuuguauaguuuuaucugaugauacaugcccugaugaaaaaauuaggaugaacagaguuguacgaaauaauuuacgaguucguuugucagauauuguuucaauucaagcuuguccugaaguaaaauauggcaaaagaauacauguuuuaccuauagaugacacuguugagggauugacugggaauuuguuugaaguguuccuuaaaccauauuuucuggaagcauaccguccuauucauaaagaugauacuuuuguuguuagaggugguaugcgugcuguagaauuuaagguaguagaaacagaucccgcuccuuacuguauuguagcaccugauacuaucauucauugugaggguaaucauauaaagagagaggaagaagaagaagcuuuaaaugcuguuggauaugaugauauuggagguuguagaaagcaacuugcucagauuaaagaaaugguugagcuaccuuugagacauccuagcuuauucaaagcaauugguguuaaaccuccucguggaauauuacuuuauggaccaccuggaacugguaaaacauuaauagcacgugcuguggcuaacgaaacaggagcauucuucuuuuuaaucaauggccccgaaauuaugaguaaauuagcuggugaaucugaaaguaaucugcguaaagcauuugaacaagcugaaaaacaugcuccuuccaucauuuuuaucgaugaguuagaugccauugcuccaaaacgagacaagacucacggagaaguggaaagaagaaucgucucacaauuacuuacauuaauggauggucuuaaacaaaauucucauauaauugucauggcugcuaccaacaggccuaauucaauugaugcugcucuuagacguuuuggacgauuugaucgugaaauugauauugguauuccagauacaacuggacguuuagagguucuucgaauucauacaaaaaauaugaaacuagcugaugaugucaauuuagaacagauugcugcugaaacacauggucauguuggagcagauuuggcaucucucuguucagaagcagcacuucagcagauccgugaaaaaauggaucuaauugauuuagaagaagagcaaauugaugcagaaguucuaaacuccuuggcuguuacuauggauaacuuccgguaugcuaugggcaaaaguagcccaagugcccuucgugaaacugugguugaaguuccaaauauuacuugggaugauauugguggucuggauaauguuaaaaaggaauugcaagaauugguucaguacccuguugaacauccagaaaaauucuugaaauuuggaaugcaaccuucccgugguguuuuauuuuauggaccaccagguugugguaagacauuguuagcuaaagcuauugcuaaugaaugucaggcaaacuucauuucagucaaggggccagaauuauuaacuaugugguuuggagaaucagaagcuaauguucgugauauuuuugauaaggcuagagcugcugcaccauguguucuauuuuuugaugaacuggauuccauugcuaaaucaagagguggaaguguuggagaugcuggaggugcagcugauagaguuaucaaccaaauccuuacugaaauggauggaaugggagccaagaaaaauguuuuuauaauuggggcuacuaauagaccagacauaauugauccugcuauucugagaccuggccguuuagaucaacucauuuauauaccauuaccugaugagaagucaagagaagccaucuucagagcgaacuuaagaaaaucaccuguugccaaggauguugauuuacaauauauugccaaaguuacauuugguuauucuggagcugaucuuacugagguaugucaaagagcguguaaacuugcgaucagacaguccauugaagcugaaaucaaaagggaaaaaaguagauuagauggagcuacacgaauggauauggaugaugaggauccugucccugaaauaacacgugaacauuuugaagaggcaaugagguuugccaggcguucugucacugauaaugauauucgcaaguaugaaauguuugcucagacauuacaacaaucaagagguuuuggaacuaauuuuagauucccugcuagcucaaauauuccuagugcaccaggaggugggggaacugaaacuaacaacuuuccagaugauggagaugaugaccuuuauaauuaa

SEQ ID NO: 447 - RNA, 402 nt, Piezodorus guildinii
augaccaucgaagacgaaucuggcccaucuggcgacuccguugauaucaacaccgcauuaaaagaaguuuugaaaggaguagugaggaauggaauaauuguucauggucugagggagucagcuaaagcucuugacaagcgacaggcuuuacucugcguccuggccgaaaacugcgacgagcccauguacaagaaacucgugcaggcccucugcuccgaacaucaaauaccauuaguuaaggucgacucaaacaagaagcuaggagaaugguccgguuuauguaaaauugacaagacaggaaacccaaggaagguugucgggugcucauguguaguuauuaaggacuggggcgaugauacaccucaccuagauguacucaaagauuauaugacagaauccaug

SEQ ID NO: 448 - RNA, 375 nt, Piezodorus guildinii
auguccggacgugguaaaggugguaaagccaaggguaaggcaaagacccgaucuucaagggcagggcuccaguuccccgucggucguauccaccgucuccucaggaaagguaacuacgccgagagaguaggugcaggagcuccgguguaucucgccgcagucauggaguaccuggcugcugaaguucucgaauuggccggcaacgcagcucgcgauaacaagaagacgaggaucauuccgcgucaccuccagcucgcuauaaggaacgacgaggaguugaacaagcuguugucgggagucaccaucgcucaaggcggaguacuucccaacauccaggccguucugcugccgaagaagacagagaagagcucuuaa

SEQ ID NO: 449 - RNA, 4497 nt, Piezodorus guildinii
augaauuugagagcugucauaaucguauuggucgcuguuucggcgcuuccaggcuacgcucaagaaaaugggaccaacuugcuuccacggacaaaaagaaauccuacaaaacuucgccauucucgacguuuugcugaaagaaugcccaccucuuccuacuaugaugacuacccgccuauuaccaauagccagaaucaggaaaaucauaaaccaauauucaccaacuguucaauguaucaaccuucuguuccugaagaguugacacauacaaccacuguuauacagguuacugcggcugauaaagauccaccugaagcaggaggaaaagugacuuauacuuuuguugcaacuccacaagaaagucagaaguucaauaucgauccugaaacuggaguuauuacuacucgacacaguuucgaucgagaugaaccgaaucgugaaaaagaaguuuauuuaacaguucgagcuaccgauaauggaaggccacagcuugaugaugucuguacauuuaaaauuauuauugaagauauuaaugauaacccuccaguauuugauaaaguugacuaccaagaauccguaccucaagauuuaccaccuaaacgugaaguaaugagaauaucugcuacugauguugaugauggaaacaacaguauuguaauguacaguuuagaaccaagaucugcagaucuaaguacuaaaagcuauuuucaaauugacaguaaaaccgguguuaucacccuugaucgagcgauugaucgugauccugguuauaaauuuaaacucagggcuacagccacagaucauggagauaucccuaaaucugcaguuauuaaccuagacauucaaguaguugagucuaauaagaaagcuccaguuuucacaucaauaccugccucaccuauuguucuucuggaaaauuucacugacuucacugaaaauauugcuacuuuaaccgcuaugucuaaugaugaaaaagcuccuguuuuugaauuaguuacuggaagaacugagcagaccaauaaauauaguacauuucgguuagagucugaugcaaacacugcucauauuaggcuugccaggcggauggauuaugaaucgauugcagaauauacacucacaauucgaauacagaacaaauucaaucuggcuucugagacuaguauuaauauccaguuagaggaugucaaugacaauauuccugccuuuacugaaguuguaucagguguuguauuagaaaaugaaccugcuggaacaccugucaugcaagucagggccauugaugcagacaguaccacugcucacaaccaggucaccuaugaauuggcagauaauaccgaaaauuucgcuauugauagauacacuggaaacauuacuacaaaaaagauguuugauagagaagaacaagauuuuuacaauguuaaggucauugccaaagauaauucuccaucugcuuuauauaaaacuggaguaccuaaugaaggucaacaaguguuucgaauugaaauagcugauaagaaugaucauccuccaaaauuuacugaagcaguauauguugcugaagcuaucccugaaaaugcuaauacuaaugcucguguuacccaaguuaaugcucaagacaacgauacugcuucacuuguucauuauaguauauuuuauggaaaugaaaaugaugcauuuguaauugaugaaauaacuggugaaauccgugucaauaaaaauuuagauuaugaaaccaggaccaauuauacuuuaaaagugaaagcuuuugauggagcuuaugaagacaacugugaggugcauauaaaaauugaaaacgucaaugauaauccuccaguuuuuguuucuuaccaaaagacaaucacuauaauggaagaagaauuauucccaggauguauugcucagcuugaagcuuaugacccagauauuccugacagaagucugccucagcauauacuuuauuuuguuguaaaagaacagcaaaguaaaugguuaaauaucaacaaaaaagguugccuuucacuaauaaagccucuagauagagauccuccuaauggcaccgagucuuggcaaguuuugauuggagcuaaagaugaagaugguggacccacuggggugcaacagaccacagagguuaucauuauguuaacagauauaaacgacaaugcuccauaucuagaaaugucacaaccaguaauuuggacagaaaaugaaccuccuggugauauugugaaauugaaugcuaaagauaaugaugggccugaaaaugguccaccuuuuacuuucaacauugcuccuucugccagcacugaaauacaaaccaaauuuacuauaucagguucaacauuaaaaucacuugucagguuugaucgugaagagaggaaaucuuauuuuguaccaauugcuaucacugauagcggcaauccuaguuugacugguacaagcacauuacauguagucauuggugauguuaaugacaauccaaugaaaaguggauauagugaaauuuuuguuuacaauuacaagggagaggcuccagauacagacauugguagaguauauguugaagacccugaugauugggauuugccugacaaacauuuugaaugggcugguauggcuggcccuuacuuugauuuggauccuaaaacuggaaugaucacaauguuacaaggaacuguugaucaaucauauauucuuaacuuuacuguuuuugaaaacgcuacuagauauuuuagugcucacaguguaacagcuacuguaaauguuacugucaaagaaauaccggaagaagcagucgauaagucaggcucuguucguuuaguugguaucacugcugaagaauuuguggaagcggauucuaaugguauuagcaagcgaacaauguuuagaaaauauuuagcaaaauucuugaacauuacugaagaaaauguugacguuuuuacuguuuuacauucuccucacaaugcaaauacaagccuauuggauguucgauuuucagcccauggaucuccuuauuauaguccagaaaagcuaaaugcugcagugagugugcauaaugcugagcuggagaaagagcucggaguggcaauucuuauggugaacauugaugaaugccuuguugaaagacaguauugugaagguucauguauaaauuuuuugaauaaaagucgugaaccgauugcaguuuacaccaauacaacaacuuuuguugguguaagggcuguuguagauccuuuuuguaacugugaaguaccuccuaggccaguuugccauaauggugguacacuuguuaauaaugacaagugugaaugugaaccuggcuuugaaggaccgcauugugagauccuaaguauuggauuuaguggcaaugguugggcucuuuauccuccauuagaaucaugugcugauucacaucucucuuuagaacuucguucaaauaaaaaggaugggcuuguauuuuacgugggaccaacuaaaccaaaucgacugaugaaugugcaagauuuuaucucuuuugaagugguagauggcuacccaguucuucuguuggauuuuggaacugguacuguaaaacuagauccuaaacaaauuagacuugaugauggugagcaacaucgcauugacauaauuuggucuagaacaacuauugaauuacaaguugauaauugcaaguuaccuucauguuuaagccuaaaauuaaaagcaggagacaaugaauuuuuaaauguaaauggaccauuacaaguaggagguucauuuguugacuucaauuaccuugauaaucacaugaacuggacucauaaaccuucaagaguuggauuuagugguuguguuaagaauuucaccuuuaauaauaaauuguauaaccuuggaaugccuggauauucaaaaaaugcagacauugguuguaaugcugguguagcuguugcaguaucuuuuggaauagauccuaguuuuauaauugcgauuauuauaugcuuagcuauauuacuaauauuguuauuggcgguuguuguacaucguagaaaaacugaugaccuuuacaaagacacugaugauaucagagagaauaucauuaauuacgaagaugaaggugguggugaaggugauaugacugcuuaugaucuuaaugucuuaagacucauguacaaugaugcuauacaggacaaaccucuuccagaucauaugaauucaaggccagaugaaguuccugauauaugugguuuucuggauggaaaaaaacagucuguugauaaugaccccgaaacuaauccuuuugaugauguuaggcauuaugcuuaugaaggcgauggaaauacuacagguucucuaucaucauuagcuucaggaacugaugaaggugauuugaauuuugauuauuuaucuaacuuugggccacguuuccggaagcuugcugauauauaugggaaagauucuagugaugacgaugaugaugaugauaauuaccaaaccacugcaucugaaagcugguguuaa

SEQ ID NO: 450 - RNA, 1164 nt, Piezodorus guildinii
augucugacgaggaguauucggaguccgaagaggagacuguaccagagcccgagccucaaaagaagacugagcguagacaaucugaaaagggcgauggagauccagaauucguuaaacgccaggaggcuaaaacaucagcuuuggaugaacaacucaaggauuacauagcagaauggagaaaacaaagggcgaaagaggaagaggaccuaaagcgccucaaagaaaagcaagccaagagaaaggucaugagagcugaagaagaaaagagacucgcagaaaagaaaaagcaagaggaagaaaggcgagucagagaagcugaagaaaagaaacagagagacauugaagaaaagaggcgucgacuugaggaagcagaaaaaaaacgacaggcaaugauggcagcucuuaaggaucaaaguaaaagcaaggguccaaacuucacaaucagcaaaaaggaagcuggucuaaacuugucuucagcacaaauagaaaggaacaaaacaaaggaacaauuagaagaagaaaaacguaucucccuuaguauaaggauuaaaccauuaaauauugaaaaucuaaacauugacagauuacgauuaaaagcuauugaacucugggauugcauuguaaaacuggaaacugagaaguaugaucuugaggaaaggcaaaaacgucaagauuaugaucuuaaagaacugaaggaaagacaaaagcagcaacugaggcacaaagcacugaagaaagguuuagauccagaggcuuugacuggcaaauauccaccuaaaauucagguugcaucuaaauaugaacgcagaguugacacaaggucauaugaugacaagaagaaacuuuuugagggcgguugggaaacauugacugcugaagaauuagaaaaaauauggaagucuagauaugaacaauuuacuaagcgaaaacaugcuaaauugccuaaaugguuuggugagagaccuggcaaaaagaaggaugcuccugaaagcccagaagaggaagaagugaaaccaaccgaugaugauguagaaccugucuaugcugaagaagaagaggagggagcugaagaagaggcagaggaagaggaggaggaagaagaagaggcugaagaagaagaagaagaggaagaagaagaggaagaggaggaagaagaagaauaa

SEQ ID NO: 451 - RNA, 852 nt, Piezodorus guildinii
auggacgcgaucaagaagaagaugcaagcuaugaagcuugagaaggacaacgcgauggaccgcgcccuccugugcgagcagcaggccagggaugccaaccugagggcggagaaggcugaagaggaggcgagguccuugcagaagaagauccaagccaucgagaacgacuuggaccagacgcaggaacagcugaugcaggucuugcagaagcuugaggagaaggacaaggcucuccagaacgcugagagugagguugccgcccucaacagacguauccaacuguuggaggaggaccucgagaggucugaggaaagauuggccaccgcaacagccaaguuggccgaagccucccaagcagcagaugaguccgaaaggcagagaaagguucuugaaaaccgcagcuuggcugaugaagagcguauggacgcccuugaaaaucagcugaaagaagccagauuucuggcugaagaagcugauaagaaauaugaugaggucgcccguaaauuggccaugguugaggcugauuuggagagagcagaagaaagagccgagaguggugaaucgaaaauuguagagcuugaagaagaacuucgcguaguugguaauaacuugaaaucacuggaagugucagaagaaaaggcaaaccagagagaagaagaauacaagaaccaaauuaagacccuuacaaacagacuuaaggaggcugaagcucgugcugaauuugcugaacguuccguucagaaauugcagaaggaagucgacaggcuggaggacgaacuuguccacgaaaaggagaaguacaaauacaucugcgacgaucucgaccagaccuucucagaacucgucgguuaa

SEQ ID NO: 452 - RNA, 789 nt, Piezodorus guildinii
auggcuguugguaaaaauaaggggcucuccaaaggaggaaagaagggaguuaaaaagaagguaguugacccuuuuacaaggaaagauugguaugauguuaaggccccaucuauguucaacacccgucaaaucgggaagacccuugucaacagaacucaaggaacuaaaauugcuucugagggacucaaaggucgaguauuugaagugagcuuagcugaucuucagaacgauacugaugccgaaaggucauucagaaaauuccgccucaucgcugaagauguucaaggcaggaauguuuugaccaacuuccaugguauggacuugaccacagauaaacuaaggagcauggucaaaaaguggcagacuuugauugaagccaauguugaugugagaaccacugacggcuacuuguuaagaguuuucugcauuggauucacuaacaaggaccagaugucccagcguaaaacuuguuaugcccaacauaaucagguucgagccauuaggaaaaaaaugguugauaacauuaccaauaacauuaguaacagcgauuuaaggguuguuguuaacaagcucauccccgauucgauagcaaaagauauagaaaaaauaugccaaggcaucuauccccuucaugaugucuauauuaggaaggucaaaguauugaagaaaccaagguuugaguugagcaaacuucucgaacugcacggugauggcaaaggcuccgacgaaccugguucaaagguuucaaggccugaagcuuaugaaccuccaguucaggaaucaguuuaa

SEQ ID NO: 453 - RNA, 663 nt, Piezodorus guildinii
augggaagaagaccagcucgcuguuaucgcuacugcaaaaacaaaccuuaccccaagucaagguuuugucguggugugccugauccuaagaucaggauuuuugaucuuggaaagaaaaaggcucguguagaugauuucccauuauguguacaucuugugucugaugaauaugaacaacuuucaucagaagcacuugaagcaggacguaucugcgccaauaaauaucuagugaaaaauugugguaaagaucaguuccauauuagaaugagauugcauccuuuccaugucaucaggauuaacaaaauguuaucgugugcuggagcugauaggcuccagacugggaugagaggagcuuuuggaaaaccacaagguacuguggcuagaguacacauuggucagcccaucaugagcguccguuccagugacagguacaaggcugcugucauugaggcacucaggagggccaaguucaaguucccaggaaggcagaagaucuauguuuccaagaaaugggguuucaccaaguaugacagagagacauuugaggaacugcgugcagaugggaaguuggcaaacgaugguugcaaugugaaguacaggagggaucauggaccuuuguccaauuggaaaaagguucaaguugaacuggcugcugcuaguuaa

SEQ ID NO: 454 - RNA, 711 nt, Piezodorus guildinii
augacuugcgccaccccuauuucgaagaaaaaaaaguucguugcagaugguguguuucgggcagaauugaaugaauuccucacuagagaacuugcugaagaagguuacucagguguugaaguucgagaaacuccaagcagaacugaaaucaucaucauggcaacaagaacucagaguguacuuggugaaaaaggacgacgcauccgagaauuaaccuccguagugcaaaagcguuuuaauuuucaaccacaaucauuagauuuauaugcugaaaaaguaccuacgagagguuuaugugcuauugcucaagcugagucuuugagguacaaacugauuggaggucuugcgguccgaagagcuuguuacggaguauugagauucauaauggaaaauggagccaaggguugugagguuguaguuucaggaaaacugagaggccaaagagcuaaauccaugaaguucguugauggacucaugauccacaguggugaccccuguaaugaguacgugaacucagcaacccgucacguauuauugagacaagguguacuuggcauuaaagucaaaauuaugcugccaugggacccaaccggaaagaauggaccuaagaauccucugccugacaaugucuguguugucaacccuaaagaugaaguuauuccuucagacauuaagacuaugggaauugaacuacauccuccagccauuuaa

SEQ ID NO: 455 - RNA, 354 nt, Piezodorus guildinii
augucuaaggcagaauuagcuuguguauacucugcacucauccuugcugaugaugauguugccguaacuggagagaaaauccaaaccauccuuaaagcagcagguguugauguugaacccuacuggccuggccucuucgcuaaggcccucgaagguaucaaugucaaggaccucaucaccaacaucagcagugguguagguguuggcgguggugcaccagcugcagcugcagguggugcugcccccgcugcugcugcagccccagccgguggugacaagaagaaagaagagaagaaaaaggaagagagcgaaccugaaucagaugaugauaugggcuucggucuguucgacuaa

SEQ ID NO: 456 - RNA, 657 nt, Piezodorus guildinii
augaguuuucuuagcaaaguuuuucuugguaaaaaagaagaaaaagcacccacagcuucugaagcaauacaaaagcuucgcgaaacugaggauauguuaauuaaaaaacaagauuuuuuggaaaagaaaaucgaaucugagcuaagucucgugaagaaaaauggaacuaguaauagaagaguugcaauccaagcacucaaaagaaaaaagagguaugagaaacaguuacaacaaauugaugguacuuuggcuacaauugaaaugcaaagagaagcuuuagaaggugcuaauacuaauacggcuguacuucaaacaaugaaauuugcugcugaugcauuaaaaacugcccauaaacauauggauguugaccaaguucaugauaugauggaugaaaucgcugagcaacaagauguugcaaaagaaauaucggaagcuauuucuaacccugucgcuuuuggaaaugacauugaugaggaggaacuugaaaaggagcuugaagaauuagaacaagaagaguuagacagggaacuucuuggaacuggucccacugcugaucaauuaccugauguuccugcuacucaguugccagccaaaccaaagccaauugcaucagaagaugaugaagaauuaagacaauuacagcaaugggcaacauga

SEQ ID NO: 457 - RNA, 456 nt, Piezodorus guildinii
augggucguaugcacgcuccugguaaggguauaucccagucagcuuuaccauaucgaagaagugucccaacaugguugaaauuaucacccgaagauguuaaggaacaaaucuacaaauuaggaaagaagggccucacuccuucacaaauaggugucauucuucgagauucacaugguguggcccaaguacgauucguaacuggaaacaagauucuucgaaucaugaaggccaugggauuagcuccugaucuuccagaagaucuguacuuucuuauuaagaaagccgucgcuaucagaaagcaucuugagaggaacaggaaagauaaggauuccaaguuccgucuuaucuugguugaguccaggauucacaggcuugcucgcuacuacaaaaccaagggcggacucccaccuaacuggaaguacgaguccagcacugcaucugcucuuguugcuuaa

SEQ ID NO: 458 - RNA, 1293 nt, Piezodorus guildinii
augauucccccgucuucucggccgcaggucacuguguacagugacaaaaaugaaccaacuggugaauuauugacucuaccugcagucuuuaaugcuccaauuagaccagaugucgucaauuuuguacaucaaaacauagcaaaaaaucacaggcaaccuuaugcugucagugcugaagcaggucaucagacuucagcugaaucauggggaacugggcgagcuguggcucguauuccccguguaagggguggugguacccaccguucaggccagggugcauucgguaacauguguagagguggacguauguuugcucccaccaggguauggcgcagauggcaccgcaaggugaauguuaaucaaaagagguaugcaaugguaucugcuauugcugcuacuggaguuccagcucucguuauguccaaagggcacaugguuaacgaaguuccggaaaucccucuuguuguuacugauaagauccaagaguauacuaaaaccaagcaggccacaaucuuuuuacaucguaucaaggccuggucugauauucagaaggucuacaaaucuaaaagauuccgugcugguaaagguaagaugcguaauaggagacgcauucagcguagaggaccacucaucaucuaugggcaagaucaaggucuaacucgugcuuuccguaacauuccugguguugaucuuaucaacguuucacgguugaacuugcuuaagcuggcaccugguggucauguuggaagguuugugaucuggacccaaucagcuuuugaucaacuuaacgcucucuauggcacauggaagaaaaaaucaacuuugaaaaaggacuacaacuugccuaugcccaagaugguuaauacugaccugucuaggcuguucaagucugaagaaaucaagaguguccuuaaagcaccaaggaagaccauaguuaggaggguuaggaaacuaaacccauugaggaacacucgagcaaugcucaagcucaauccauucgcugcaguucugaagaggaaagccauacuugcugauaggaaacuuaagcuugagagggcuauugagagaucaaagaaggaaggaauugagcuuaccccucaucaaaagagguauguugcuaugcucgagcgaaggaaagcucagaucaaagcugcuaaggcugcuaagccuaaaaaggucaagaaaccaaaagcugaaaaaacugaagcugcugaagcaaagaaagcuaguguaacuaaaaaaccagcaaaaaaggcaacaacagcugcugcucccaaaccugccaaaaaauga

SEQ ID NO: 459 - RNA, 690 nt, Piezodorus guildinii
auguuaaaaucgcaaaggccuuggcauaaaguguucucguguagugcuuucaggaacccuuccauuuuaagugaaaugacgggguuuucggacaagcccaucuuaauugauggcaaaggucacuuacugggucggcuugcagcuauaguggcuaaagcugccuugaauggcaacaggauaguuguuguuaggacugaacaaauuaauauuucaggaaacuuuuucaggaguaaacuuaaguauuugucauucuuaagaaaaagauguaauguuaauccagccagagguccuuuucacuuccgggcacccagcaaaauuuuguaucgaacuaucagaggaauggugccacacaaaaucgaaagggggaaggcugcuuugaggcguaucaaguuguuugagggaaucccuccccccuaugauaagaggaaacgaguaguuguuccgacagcuaugagaguauugugcuugaaaccugguagggcuuauugccaucuugguagguugucuucugaaguugguuggaaguacaaggauguagugagagcucuugaaaccaagaggaaagucagggcaguuuuugauauucgcaagagaaauucccuaaagaaauugacuaaacaagccaaggaaaagauguccaaagcaaaugcuaauuauacugcuguaaucaauuccuauggauaucguuaa

SEQ ID NO: 460 - RNA, 3585 nt, Piezodorus guildinii
auguccccucccgggcaucuaccagggguggucgggugugaggucggcgaaccacucucauggaauaagaugaguggaucggccagugguuccucaucuaagaaaagaaagaaaccugaaaacaaaccucagucucagauuaacaagugccuuaaugaaaagcggaggagggagcaggagaacauauacaucgaggagcuugccgagcuuaucucugccuccuucacagacaugagcagccucucugucaagccggacaagagugccauccuacaggagaccguucuucagaucaagacuauaaaaggcagaacagcgacuagcgaugccguccaacaaggagaagucucaucgagcaagccuaccauucuagcuaaugagguuuuuggcccgcucuuacuugaggcuuuagauggcuuccuuuuuauuguuaauccugaagggaaaguugaguuuuguacugagaauauaacucaguuuaucaaauauugccgugaagagguucuuggucagccgguguauaauauaauccaccacggggaccacgccagauuuucaucuugguuguugccuaugaguuggucuaacgacuaccaaccaccaagaccgagaacuuuuaacugucguuuccucaucaaaccucccccagauacgacuguagaagaaaaacaacaaagaccguccaaauaugaaaauaugcagaucucuucaacccagcuuccucaaagcagugguauagacaaagaugaugaugguaguagugagucuggaccuuguuugauguguauagcuagaagaaucccuccaaacgaaaagccagcugggucucccaucgagcaguuuacuaugaaauuaaauaccucaggaaggauuauuaagauagauaauacugguguuucagcuccuuauucucaguacuuuaguaagcaggaucuaaugcaucggaauuuagaugaacuuguucaaaguagugaugugcccaaagugguuggucauguaaaagacgcauugacuacagggcaaagcucuacguccauuuauaaacuucaaauuggccaugacaaauauguuaauguacaaacaaaauuuaagcuauuuaaaucagccaaucgccagauggaaaaugacuuuauaauggcuacucauuccauauuuggagauaaugaagccaaucuugaaauuggcucuccugcugguaacagcaaucaaucaggaaguggaaacaacaacacuaaccaacagcagcagcaacaaaugcaaccacaacaacagcagagcucuuccaccgguggagucggugguccacuuauugcuaacggugcuaacagagaucuggguaacaccaucacucucaacaccagcaccucuuuugguuccgucacucucaacucggcugauauagauauauuauccuccuuugauuuuccaaguacaaccuggccggaaauaagcagcgauuuagaauggaaaaagucugaguuucguacuccaguucaaaguccaguacuucccaauccaccagcucaaucccccaccgccacuccuuuuuccacuccauauucuuuaucaccaauucaugaggaugcuccagaggaagauucuguuaggcuccgaaaccuucucacaaccaagaggccaucuacggagucagaugauggugguggagguaauauugcucagcguaauaacaaccgaauauugaagaaucuucuuaaccaagaggaugaagaaucacagccccaggauucuaaaccaccaaauaacaugcuacuaaagcuuuugaacacucagagugaugaugaugauguggaggcuagggcuggguugaagaaacagaaugagcuucuccaucaacugcucaaggaagaggauaacaaccaagacaaccagcaaaguggugacgauggucuccucaaaagccuuggauucaggggagaagggagugaggaaaguagagggggaaggaaacgcccgucuucagaugaaagugaagaccagccagguucaaagagaucuuccucuucucuguuagaugcugugccuccucccccgacccccucggcacccucugcugcauccgguaaaucgaggcuuugggagaaaaaccagaugcuugcaucucuuuuagcaaagcguccuacuacuccagcuucgauuccaccaaucccugcauccguaauuucugcuacgccucaggauaagcugcaacgucuuguuaaacauccuccuacaggcuggucuggagguagcguccaagccggcgcaggcucaccuggucagagcaggucaggacgcagcccaggcuacacuggggccaacaccugggacucggccucuucagauccaguccucucagacauccuugaucaagucauagagauaguaccugauguuaauacagaugcaccaguacuaaugaauaugaucaacucauuggaagcugagacucagccaucuguucaacaacaauuugcaucucagcaagaauuuuugaaugaaaagauggcgauaaacgcuauacaaaagucuuugaugcucugcgaaucugcuguuaaaagcccuaccuaucaaacuacaaugucccagggaucuccucaggcacaaccacagccucagccccagcaacaaucucaaccucagcagcagcaacagcagcagcaacaauuucacccuccgccaauguaucaacaaagacaaagguuucccauucaacaacagccacaaaucaggcaacaacaacaauuuagcauuucgccguuguuaauggcucagcggaaaaugcuuaaccauaaucagcagaugcaacagaagcagagacuucuccaguugcagcaacagcaacagcuugugauuccaucuaaugcuacugcccaaaaugcugaccccgcgcuccacaauauugauagccuuaucaauaauacgguugcuccgaacguaucucuucagagaucaagcagcguucccgauucucagcuguccccuguuggaaguuacccuggccuaggaucuguaccaucaccaggacagagaaggccuuucucaccugucaacggggggaugacgaguuucucgagcggugguggcgcgggcccccccgugucaggaaguggcccccaagccagacuuucccccagcucccuccaaggauaccagcaacaaccccagcugucuccaaggcucacucagggccagcaaaacuaugguggcgguggugcuagcuggucucagcagaauucucggcuuucugugcagcaacaggaaaacccuguccucaaugcucaauugacgagcggaggacgaggauacgcuaggaauacuucagccggguuacccccugugaggucacuggcuggcccacagcgauuccccaccgcggcugaccaacaggcuggugcugcuucauaccaauuccggcugcagcgccaggugucagcaccuccaccucaacaaucaucacccaacccacaguuaccaggugguaauaauggcgugacagaguaugugaggcaagagcugcgcgcgauggugggcgccagaacgagcgccggcgggcgcccccagguccccggcucucuuccccucccc

SEQ ID NO: 461 - RNA, 525 nt, Piezodorus guildinii
uuucaaaaaauauuguuagggcggacugguaacaacaacguggguuucuuugagguucuucacgaaucgucggugcgucggauuaucaauuucauccgaauucaucaauccaaaauggggaagauuaugaaagcugguaaggugguguuggugcugagugguagguaugcaggaagaaaagccauaguucuuaaaacuugugaugaaggaacacaagagaaggcuuaugggcaugccauaguugcuggcauugaucgcuacccccguaaaguucacaaaaggaugagcaaaacuaagauccacaagaggucuaagaucaagcccuuuuugaagguuaugaacuacaaccaccuuaugcccacucguuacacaguaucugagaucgcuccugaccaaaagguagugacaaaagauuugaaggacccaaugaagaaaaagaagauccguuuccaaguuagggugaaauucgaagaaagguacaaacaaggcaagagcaagugguuuuucgaaaaauugagguuuuaa

SEQ ID NO: 462 - RNA, 597 nt, Piezodorus guildinii
auggccgugcaaaauaagaaaaagggcgcugcugccccugagaagaaaaaaucccucaaaaaggaaccuaaggacaagucaaaaaauguuaugaaagaagucagaauccgaaaacucugccugaauauuuguguuggagaaucuggcgauaggcugacaagagcugcuaagguguuggagcaguugacuggacagcaaccugucuuuucuaaagcuagguauacuguaaggucuuuuggaauccguaggaaugaaaaaauugcuguucauuguacaguucgaggagccaaagcagaagaaauuuuggaaagaggauuaaagguccgggaauaugaacugagaagggauaacuucucugacaccggcaauuuuggauuugguauucaggaacacauugauuugggaaucaaguacgaucccaguauugguaucuaugguuuggacuucuacguuguucuuggacggccagguuucaauguugcccaccggcgaaggaagacugguguaguugguuuccaacauagguuaacaaaagaagaugcgaugaaaugguuccaacagaaguaugauggaaucaucuuaccuggaaagaaguaa

SEQ ID NO: 463 - RNA, 5856 nt, Piezodorus guildinii
auggcgucgaaaggaccugcagguaugcaaguaggggcugaugaccccgauccaaccccauaucucuucguaucccuggaacagaagagaaucgaucaaacgaaaccauacgacgccaagaaggcuugcuggguccccgaugaagccgaggguuuccuccagggugaaauccaaggaaccaagggagacaucguauccgucaagcucccugguggugaaacaaaagacuucaagaaagaucuggucggccaagugaauccacccaaguucgagaaaugcgaggauauguccaacuugaccuaccucaacgacgcuucuguccuguauaaccuuaagcagagauacuaucauaagcuaauuuacacauacuccggucuguuuugcguugcuaucaacccuuacaagagauuccccguauacacauugaggugcgccaagcuguacagagguaagaggaggaaugaagucccaccucacaucuuugccaucucugacggugccuacguaaacauguugacaaacaaggagaaccagucuauguugauuacuggugagucuggugccggaaagacugaaaacacgaagaaaguaauugcguacuucgccacuguuggugccagcacaaagaaagaugaagcauccgaaaagaaggguacccuagaagaucaagucguacaaacuaaccccguacuagaagccuucgguaaugccaagacaguccguaacgauaacucuucucguuucgguaaguucauccguauccacuucggaccaucaggaaaacuggccggagcugauauugagaccuaucuacuggagaaggcucgugucaucucccaacagacccuggaaagauccuaccacauuuucuaccagaucaugucuggugccgucaagggagucaaggccaagugcuugcuuucugacgacauuuacgaguacaacuucaucucccaggguaaagucacuauugcagguguagacgaugcagaggaauuucaacugacagacgaagccuucaacgucuuggguuucacccaacaagagaaggaugacaucuacaagaucaccgcugccguuaugcacauggguugcaugaaguucaagcagaggggucgcgaagaacaggcugaagccgauggugucgaagaagguaucagggucgguaaacuccuggguaucgacggugaagaacucuacaagaacuugcuuaagcccaggauuaaggucgguaacgaauucgucacccaggguaggaauguacaucagguaacauacucaguaggugccauguccaaggguauguuugaucgucucuucaaauucuuggucaagaaauguaacgagaccuuggacaccaaacagaagaggcagcacuucauugguguacuggauauugccgguuuugaaauuuucgacuacaauggcuucgaacaauuguguauuaacuuuacaaaugagaaacuacagcaauucuucaaccaccacauguucguccuggaacaagaagaauacaaaaaagaggguauuaauugggccuucauugauuucggaauggacuugcuggcuuguaucgaacuuauugaaaagccuauggguauccucucaauucucgaggaagaaucuauguuccccaaggcuaccgacaagaccuuugaggacaaacugaacuccaaccaucuuggcaagucccccaacuuccagaagcccaaaccaccaaagccagguugccagccugcucacuucgcuaucggucauuacgcugguguuguaucauacaacaucaccggauggcuggaaaagaacaaggacccucugaacgacacugucguugaccaguacaagaaggguuccaacgcacucuugugcgaaaucuuugcugaccauccaggacagucuggugcugcuggugcugaugcugguggcaaggguggccguggaaagaagggugguggcuucgccaccguaucuuccuccuacaaggaacaauugaacaacuugaugaccacucugaggagcacacagccucacuuuguccguuguaucauucccaaugaauugaaacagccaggugucaucgacucucaccuggucaugcaccaacugacuuguaacgguguacuugaagguauccguauuugccguaaagguuuccccaacaggauggcauaccccgacuucaagcuccgauacaagauccuuaacccagcugccguugagaaauuaaccgacgagaaagcaauggccggagucaucuuggaauccacagggcucgaucccgacauguacaggcuuggccacaccaaggucuucuucagggcugguguccugggucagauggaggaacuucgugaugaaaggcuuagcaggaucaucuccuggaugcagucauacauccgugguuaccucugcagaaaggaauucaagaaacuccaagaacagagacucgcccuccagaucguccagaggaacuugagaagguaccucgccuugaggacauggaacugguggaagaugugguccaaagucaagccucugcucaacguagccaacguagaggaagagaugaggaaauuggaggaguuggucgcccaaacccaagccgcccucgagaaggaagagaaggcaaggaaggagguugaggcccucaaugccaagcugcucgcugagaagaccgagcucuugaggaaccucgaaggagagaagggcacccuuggaagucuucaagagaggucugccaagcuccaggcccagaaggcugacuuggagucccagcuuauggacacacaagaaaggcuucaacaagaagaggacgcuaggaaccaacucuuccaacagaagaagaaacuugaacaagaaaacagcagucucaagaaggacauugaggaccuugagcuuuccgucaccaagagcgaccaagacaaggcuagcaaagaacaucaaaucaggaaccucaaugaugagauugcccaccaagacgaacucaucaacaaacucaacaaagaaaagaagauccagagugagcacaaucagaagacugcugaggaacuucaagccgccgaagacaaaaucaaccaccucaccaaagucaaagccaaacucgaacagacuuuggaugaacucgaagacucacucgaaagagagaagaaacuucguggagauguugagaaggccaagaggaagacugaaggagaccucaaacucacccaggaagcuguugccgaccucgaaaggaacaagaaggaacuugaacagaccauccagaggaaagacaaggaaauggcuucccucacugccaagcuugaagacgagcaaggcauuguuaacaagaccggcaaacagaucaaggaacuccaggcccguauugaagaacuugaggaagaaguugaagcagagagacaagcucguggaaaggccgagaaacaacgugccgaccucgcccgcgaacuugaagagcucggugagagguuggaagaagcugguggugcuacuuccgcccaaaucgagcucaacaagaagcgagaagcugagaugagcaaacucaggagggacuuggaagaagccaacauccaacacgaaagcacccuugccaaccuccgcaaaaagcacaacgaugccgucagcgaaaugggugaccaaauugaccagcucaacaaacuuaagaccaagguugagaaggaaaaaugccaauaccugugugaguugaacgaccuccgugcuuccaucgaccacuugaccaacgagaaggcugccaccgaaaagauugccaagcagcuccaacaccaacucaacgaaguccaaggaaaacuggaugaagccaacaggucucucaacgacuucgaugccgccaagaagaaguugucaauugaaaacucagaucuccucaggcaacuugaggaggcugagagccaaguaucucaauugagcaagaucaagaucucccucaccacccaauuggaagacaccaagaggcuugccgacgaagaggcuagggaaagagcuacccuucugggcaaguuccguaacuuggaacacgaccuggacaaccucagagaacagguugaggaagaaucugaagccaaggcagauauccagaggcaauuaagcaaggcuaaugcugaggcucaacucuggaggcacaaguacgagagcgaagguguugccagagcugaagaacuugaagaagccaagaggaaacuccaggccaggcucgcugaggcugaagaaaccaucgaaucucuuaaccagaaagucauugcucuugagaagaccaagcagaggcucgccaccgaggucgaagaucuucaacuggaagucgaccgugccaaugcuauugccaacgcugcugaaaagaaggccaaggcuaucgacaaaaucauuggugaauggaaacucaagguugaugaccuugcagcugaacuugaugccagccaaaaggagugcaggaacuacucgacugagcucuucagguugaagggagcauaugaagaaggacaagaacaauuggaagcuguccgcagggagaacaagaaucuugcugaugaagucaaggaucuccuugaucaaauuggugaggguggacgcaacauucacgaaaucgagaaacagaggaagaggcucgaaguugaaaaggacgaacuccaagcagcucucgaagaagcugaagccgcccuugaacaggaagaaaacaagguucucagagcucaacuugagcuuagccaagucaggcaagaaauugaccgucgcauccaggagaaggaagaagaauucgaaaacaccaggaaaaaucaccaacgugcccucgacuccaugcaagccaguuuggaggcagaagcuaaggguaaggcugaggcacuccgcaugaagaagaaacuugaagcugacaucaacgaacuugaaaucgcccucgaccaugccaacaaggccaaugcugaagcucagaaauccaucaagaaauaccaacaacaacuuaaggauguccagaccgcacucgaggaagaacaaagagcuagggaugaugcccgggaacaacuugguauugccgaaaggcgagccaacgcucuuggaaacgaacucgaagaauccagaacucuccuggaacaggcagaccgcggccgucgccaggcagaacaggaacucaccgaugcucacgaacaaaucaacgaacucgcagcucaagccacaagcgcuucugcugccaagcgcaagcucgaaggagaguugcagacacuccaugccgaccucgacgaacuucucaacgaagccaagaacucagaagagaaggcuaagaaggcuaugguugaugcugcgagguuagcagaugaacucagagccgaacaagaccaugcccagacccaggagaaacuccgaaaggcccucgagacacagaucaaagaacuccaggucagacuggacgaagccgaaaauaacgcccucaaaggaggcaagaaggccauugccaaguuggaacagagagucagggaacucgaaaacgagcuugacggagaacaaaggagacaugcugaugcccagaagaaccuccgcaaaucugagcgcaggaucaaggagcucagcuuccaaucugaugaagauaggaagaaccacgaacgcaugcaggaccuuguagacaaacuccaacagaagaucaagacuuacaagaggcagauugaagaagccgaagaaaucgcugcccugaaccucgccaaauuccgcaaagcccaacaggaacuugaagaagcugaggagagagcagaccucgccgaacaggcuguuacuaagcuaagaacgaaaacuggaggcagagcuggaucaacugcaagagccaugagcccagugaaucgcaacccuaugaggccc

SEQ ID NO: 464 - RNA, 768 nt, Piezodorus guildinii
augaguucuauaggaacaggguaugaucugucagcaucacaguuuucuccugaugggaggguuuuucaaguugaauaugcacaaaaggcuauugaaaacagugggacuguuauuggucugagagguaaagaugguguuguuuuagcagucgaaaaauuagucacaucaaaacuauaugaaccgggugccaauaagagacuguuuacuauugacaaacauauuggaauggcuguagccggauuaauaucagaugcaagggcaguugcagaaguggcuaggacagaagcugcaaauuacagaucucaauauaagagcaguauaccucuuaaguacuugaaugagcgagugucuauguacaugcaugcuuauacccucuacagugcugugaggccauuuggaugcaguguaauacucaguacuuacacggaagaggacggcccagaaauguauaugauagacccaucaggaguuucauaugguuauuuugguugcgcuguuggaaaggcaaaacaggcugcaaaaacugaaauagaaaagcuaaaacucaaagaaaugucaugucaggagcucguaaaagaagcagcacgaauuauuuaccucguccaugaugagcugaaggacaaacaguuugagcuugaaaugaguuggauuggcucucacacgaaugguguaagucaacaaguuccugccaguguccaugccgaggcagagaaagaugcuaaagccgcgauggaagaagauuccgauucagaaacagaagauauauga

SEQ ID NO: 465 - RNA, 801 nt, Piezodorus guildinii
augguugaaacaucugugguuacuccugcagcuccugcugccaauaagaaagcagggucaaccagaaagccucagaggagaaauuacaaccucgguucaggaguuuauagguucagcagaacucgcauguuccauaagaaggcucuauggaaauuuauugguaagaaaacaccuaagacuccccguccuaaaaggaaaacuacucuugaaaaaaagauugguggugagaaaaauggaggcacucguacugucuauuuaaagaaaaggacuaaaucauauccuacagcuaacaaggugaggaaacacccaaguaaaaccuauuuuugucagcacaagagaagguuccgugccucccuaaaaccugguuccauugucauucugcuugcugggcuucacaaaggaaaaagggcaguucuuuuaaaaaauaugccuagugggcuucuuuugguuuccggaccauacacccugaauggaguaccucuuaggagaauacauccuaacuauguuauugccaccucgacucagaucgauuuguccggaguuaaguuaccugagcauaugaaugauaaauauuucaagaggguuaaagcuaaaaaggccaagaagagugauggugaaaucuuugcugcuaaaaaagaacucuacaaaccaucugaacagaggaagaccgaccagaaggagguggacaaacaaguuuugcaggccauuaagaaacaugaacauagccuacuucucaggaaguaccugugcacaauguucggccuucgaagcagucaguacccucacagaaugaaauuuuaa

SEQ ID NO: 466 - RNA, 732 nt, Piezodorus guildinii
augucuaccaaagacaaauuggccauuuucccuucucgaggagcucagacuuugaugaaaggaagacuugugggcgcucaaaaaggucacaguuuguuaaagaaaaaagcagaugcccuacaaauuagguuuaggaugauccucagcaaaauaauugagacaaaaacgcuuaugggagagguuaugaaagaagccgcuuuuucauuagcugaagcuaaguucgcuacuggagauuucaaccaacaaguuuuacaaaauguucagaaagcucaaauuaaaauaagaacaaagaaggauaacguugcaggugugacacuacccguuuucgaaagcuaucaagacggaacagauucuuacgaguuggccggacuggcuagaggugggcagcaguuggcaaaacugaagaagaacuaucagaaagcuauuaaauugcucguagagcuggcuucauugcagacuucuuuuguuacguuagaugagguuauuaagcuuaccaauagaagaguuaaugcuauugaacacguuauuauaccaagaauugaacgcacacuucaauauauuauuucugaauuggaugaguuggaaagagaagaauucuacagauuaaaaaagauucaagauaagaagcguaucgcccgucaaaaagcagaagcgaagaaggcgguggacgcagcugcagcaacgauggcuagcaacauucucgaagagaacgacgaggaucuccuguuuuag

SEQ ID NO: 467 - RNA, 666 nt, Piezodorus guildinii
auggcuccgaaaggaaauaauaugauucccaaugggcauuuccauaaagauuggcaaagguuuauuaagaccugguucaaucaaccagcucguaaauaucgccgaagaaugaagagaguaaagaaagcuagagcucuggcucccagaccagcaacacuuuuacguccugcagucaggugcccaacugugcgcuaucauacuaaauugagaccuggcagaggcuucacauuggaagaaauuaagaggguuggauuaugcccuggauucgcaagaucuaucgggauugcagucgaucauaggagaagaaacaagucggucgaaucuuuacaguugaauguacaacgccuaaaagaauaucaagcuaagcugauccuguucccauccaagaagagcaagaaggugaagaagggagaagcuucggcggaagaacaggcuuuagcugcccaaguuucuucaccuguuaugccaaucaagcagaccguuguaaagaugaaagccagaacaauuacuccugaggacaagagcuucucugcuuaugcagcuuuaagaaaggcaagggcagaugaaagacuaguaggaaucagagcuaagaggcugaaggaagcugcugauaauccugaaacuguugagaaggcugcaaaacagaagaaaauuaaaacaaaauaa

SEQ ID NO: 468 - RNA, 618 nt, Piezodorus guildinii
ccucuauggcugucgauuccguguuuauguuugcagcagguuauagugcuacuacuacacgucauuuuauguaauuuagauauggauggguuacuauuggaaccuacucuuuacacugugaagggaaugguaauuuuggacaaugaugggcaccgaauacuagcuaaguauuaugauccaaguguguuuccaacuucuaaggagcaaaaggcauuugaaaaaaauuuguucaacaagacccaucgggcuaaugcagaaauaaucauguuggaugggcuuacauguguuuauaaaucaaauguugauuuauuuuuuuauguuaugggaaguucgcaugaaaaugaguugauauuaaugagugugcuccagugccuuuaugauucuauuagucaaauauugaggaaaaauguagagaagcgaacucuguuagaaaauuuagaaauuguaauguuagcaauggaugaaauaugugauggaggaauaauauuagaggcagacccaacaaguguuguacaaggaguagcuuugaggacagaugauaucccacuuggugaacaaacuguugcacagguucuucagagugcaaaggagcaaauuaaaucugcaauauugaaauaa

SEQ ID NO: 469 - RNA, 549 nt, Piezodorus guildinii
auggggaauauguuugcaaauuuguucaaaggccuguuuggcaaaaaggaaaugagaauauugaugguuggucuugaugcugcuggaaaaacaacuauuuuauauaaauugaaauuaggagaaauuguaacuacaaucccaacuauuggauuuaauguugaaacuguugaauauaagaauauuaguuucacaguuugggauguagguggucaagacaaaauucgaccccuuuggcggcauuauuuccaaaauacucaggggcucauuuuuguuguagacaguaacgauagggaacguauuggugaagcgagggaagagcugaugagaaugcuugcagaagaugaauuaagagaugcaguucugcuaauuuucgcaaacaagcaggacuugccaaacgcuaugaacgcagcugagauaacagacaagcugggccuacacucauugcgcaaucgcaacugguacauccaggcgacgugcgcgaccucaggcgauggucucuacgaaggccuagauugguugucgaaccaauugaagaaugccaaccgcuag

SEQ ID NO: 470 - RNA, 384 nt, Piezodorus guildinii
augacugacgaaguuaaucccaaagcuuacccauuagcugaugccacccucacugcuaagauauuaaauguugugcagcaagcucucaacuauaagcaguuaaggaaaggugcuaaugaaucuacaaaaacuuugaaucgggguuuggccgaguucauagugauggcugcggaugcagaaccauuggaaauauuguugcaucuuccucuguuaugugaagacaagaaugugccauauguuuuuguccgcuccaagcaagcucuugggagagcguguggagugucccgcccggucgucgccugcucggugacgcucaacgaaggaucucagcucaagccgcagauaacgaaaauacaacaagacauugagaggcuuuuaguguaa

SEQ ID NO: 471 - RNA, 1302 nt, Piezodorus guildinii
augccugauuaucuuggagaugauaugagaaaaacuaaagaggagaaggaggaagaaaaggauauuaaaucucuugaugaagcugauaucgcuuuacuuaaaacuuauggacaagggcaauacacgaaaagcaucaaaagugucgaagaugauauucagaccauuaucaaacgugucaaugagcugacagguauuaaggaaucagauacugguuuagcuccuccugcguuaugggacuuggcugcagauaagcagauacuucaaaaugaacagccguuacagguugcuagauguacaaaaauuaucaaugcugauuccgaagauccaaaauacauaauaaaugucaaacaguuugcaaaauuuguaguugacuuagcugauucuguagcaccuacagauauugaagaagggaugcguguuggugucgauagaaauaaauaucaaauucagauaccucuuccaccaaaaauagauccaacuguaacaaugaugcagguugaggaaaaaccggaugucacuuauagugauguuggugguuguaaugaacaaauugaaaaauugagagaaguuguugagacuccuuuguuacagccugaaaaguucgugaauuuaggaauagagccaccaaaaggaguucuucuuuuuggaccuccugguacaggaaaaacacuuugugcgagagcuguugcuaacagaacugaugccuguuuuaucagaguaauugguucagaacuuguccaaaaauaugucggggagggugcaaggauggugcgugagcuauuugaaauggcuagaaguaaaaaagcuugccuaauuuucuuugaugaaauugaugcuauugguggugccagguuugaugauggagcugguggugauaacgaaguucaaagaacgauguuggaacuuaucaaucagcuugaugguuuugauccuagagguaacauuaagguuuugauggcaacaaauagaccugacacuuuggauccugccuugaugaggcccggaagacuggacaggaaaguggaguuuggauugccugaucuagaaggucguucucauauuuucaaaauccaugcacgcucgaugaguguagagagggauauucgauuugaguuacuugcucggcucuguccuaacaguacaggugcugaaaucagaucaguguguacugaggcuggaauguuugcuauucgagcucgaaggaaaguugcuacugaaaaggauuuccuggaagcagugaauaaagugauuaaaucuuaugcuaaguucucagccacuccaagauauaugacauauaauuaa

SEQ ID NO: 472 - RNA, 444 nt, Piezodorus guildinii
augaagaugaacaaguuggugaccucuucuaggaggaaaaaucguaaacgucauuuuacugcuccaucucauauuagaaggaaauugaugucagcuccucucuccaaggaacucaggcagaaguacaauguccgcaccaugccuguuaggaaagaugaugaaguucaaguaguuaggggacauuauaaaggacaacagguaggcaaaguuauucaggucuacagaaagaaguuuguuauauacauugaaagaauucaaagagaaaaagcaaauggugcaagugucuauguuggcauccauccuuccaaaacaguuauagugaaacugaaaauugacaaagauaggaaagaaauuuuggauagaagaucaagaggaagagcccuagcccuuggcaaagacaaaggaaaguacaccgacgagaacacagcaauggauacaucuuaa

SEQ ID NO: 473 - RNA, 2868 nt, Piezodorus guildinii
auggcugugguggaacaaccuuguuauacccugauuaauuuuccaucagauuuagagccucccaaugaaaugcagcuaaaauccgauuuagaaaauggagacacuaaagcgaaaauugaagcuuugaaaaauauuauucauuugauugcaaauggagagcguuuaccugguuuacuuaugcauauaauacguuuuguuuugccaucacaagaccacaccauuaaaaaauuacuccuuauauuuugggaaauuguuccuaaaacuacuccagauggcaaacuucuucaggaaaugauuuuaguuugugaugccuaucgaaaggacuuacaacauccuaaugaauuugucagaggauccacauuacgcuuucuuuguaaacuuaaagagccugaauuacuugaaccuuuaaugccugcuauuagagcuugcuuagagcaucggguuucauauguucgaagaaaugcuguacuugcaauauuuaccauuuauaggaauuuugaauucuuagcaccugaugcaccagaacuaauugcuaauuucuuagauggugagcaagauaugucauguaaaagaaaugcuuucuugaugcuccuacaugcugaccaagaacgugccuuauccuauuuggcuucaugucuugaucaagugaauucauuuggugacauacuucaguuaguuauuguugaauuaauauauaagguuugccaugcuaacccuucagaacguucucgauuuauacgcuguauuuauaauuuacucaauucuaauaguccugcuguucgauaugaagcugcugggacuuuaauuacgcuuucgaaugcuccuacugcaguaaaggcugcagcuucuuguuacauugacuugauaauaaaggaaagugacaauaauguuaaauuaauuguauuagaucguuuaauaucacuaaaagagauuccuacacaugagaggguucugcaggauuuaguuauggauauauuacguguguuagccaguccugacauggaaguaaagaaaaaagcauuaagucuagcacuagaucucacuacuucaagguguguugaagaaaugguuuuaauguugaaaaaagaaguugcuaaaacccauaauuugacugaacaugaagaugcuggaaaauaucgucaacuucuuguuagaacucuccauuccuguuguaugaaguuuccagauguugcugcuucaguaauaccuguauuaauggaauuucucucagauacaagcgaacuagcuucauaugauguccuuauauuuguccgagaagcaauccauaaguuugauucuuuaagggcuuugauaauagagaaauuauuagaagcauuuccaacaauaaaaucuaugaaaguucaucgagcugcucuuuggauauuaggugaauauacuacuucaguuacagauauuaaagaagucaugaaacaaauaaaaaaugcucuuggagagauaccacuuguugaugaugaaauaaaaagagcuucuggagagaaaguugaggaaguagaucaucgugaucaagugaagcuuguuacaucugaugggacguaugcuacacaaucaauauuuaacaccauucuuucaauaaagaaagaggaucgaccaccucuuagacaguacuuaauugauggggacuuuuuuauuggugugucuguggcuucuacacuugugaaauuagccuuacguuauaaagagcuuguuaaacaggaaaauauguaccauaaauuuuuugcugaguguaugcuuaucauuucaucaauaguacgucuggguaaaucaggauauccaucaaaacagcuuagcuaugaugauuacgaacgaauguuacuuugucuaaagguucuuucagaaaauaaugcuccuauuauaaaaauuuuuaacaccgauugccguaacgcucucgcuaauauguuaguugcacaacagaaugaagaguauucacuuauaaaggcuaaagaaaagucuguucauacuauccaaguugaugauccuguaucauuuuuacaauuaucaacaaugcgaucaucugauuuugguucugaaaauguuuuugagcuuagucuaaaucaagcuguuggaggaccuaauacagcugcaaacacaaccgagcuuccauuuucugccaguaaauugaauaaaguaacucaacuaacuggauuuucagauccuguuuaugcugaagccuauguucacgucaaucaguaugauauaguacucgauguuuugauuguuaaucaaacaggcgauacacuacaaaacuguacacuugaacuggcaacucuuggugaucugaaacuugucgaaaaaccucagccuuguguucuggcuccuuaugauuucuguaauauuaaagcaaauguaaaaguugcaucuacugaaaauggaaucauauuuggcaauauuguuuaugauaucaguggugcugcuucugacagaaauguugucguucuuaaugauauccauauagauaucauggauuauauuguuccugcuacuuguucagauacagaauuccgucagaugugggcugaauuugaaugggaaaacaaagugucuguuaauacguauuugguugaucuucaugaauaucuuggacauuuauuaaagagcaccaauaugaaauguuuaacuccagaaaaagcucucuguggccaauguggauucauggcugccaauauguaugcccguucaauuuucggagaagaugcauuagcuaacuuaagcauugaaaaaccauuuaauaagccuaaugccccuguuacuggacauauuaggaucagagcuaaaagucaggguauggcauugagcuuaggagauaaaauuaauaugacucagaagaaaccuacuaucauggcccaguga

SEQ ID NO: 474 - RNA, 504 nt, Piezodorus guildinii
augccuuuucagagguuuguugaaacgggaagaauagcauauauugcugauggaccuuaccagggcaaguuaugugcuauuguggauguaaucaaucagaccagggcuuuaguugaugggccagaaacuggaguaccaagaugugguauaagguuaaaccaauugcaucuuacaaaguucaggauucguuucccuuacaccgcuucuacacgcguuguccgaaaagcuuggaaagacagcaauuuggaugccaaguggaaggagaguguuugggccaagaaguuggaagccaaaaaaaucagagcaaauaugaaugacuucgacagguuccgccuuaacaaugccaggagaaccaggagcaagaucacuaccaaugccuucauguuguugaaaaaacaagcaaagaaggccaagaaaaccgaagccaagccuggacagaagccuaaggacaaaaaaccugaugcuaaaaaagcaccugcuaagaaagcagagaaaaagaaguaa

SEQ ID NO: 475 - RNA, 5043 nt, Piezodorus guildinii
augucucaaauauuaccgauacgcuuccaagaacauuuacagcuuucgaguguaggaauaaacccaacuaguguaggcuuuaacacauuaaccauggaaucugacaaguucauaugcguuagagaaaaaguuggagaaacuucucaaguugugauaauagauuuaaaugauaccgcuaauccaauaagaagaccuauuucagcggauucagcuaucaugaacccagcuaguaaaguuauagcauugaagggaaaagcuggcacugauggaacaaccacccagaaaacauugcagauuuuuaauaucgaaaugagaaguaagaugaaagcacauacuaugacagaugaaguaguuuuuuggaaauggauaucccuuaauacacuugcguuagucacugaaacgucuguuuaucauuggagcauggagggugacucucaaccagugaaaauguucgauagacauucuagccugaaugguugucaaauuauaaauuacagaacagaucccaagcaaaccuggcuuuuacuuauuggaaucucugcucagcauaaucguguuguuggagcuaugcaauuauauucaguagagcgcaaaugcucacagccgauugaaggacaugcugcaucauuugcucaguucaaaauggaaggaaacccugacguaucuacuuuguuuugcuuugcaguucguacaccgacaggaggaaagcuucauauaauugagguuggacagccccccucaggaaaccagccauucgcuaaaaaagcaguugauguauuuuuuccgguagaagcccaaaaugauuuuccaguugcuaugcagguuagcucuaaguaugauguaaucuaucuaauaacaaaguauggauauauucaucuguaugauuuggaaacagcuacaugcauuuacaugaaucguauuagcauugauacuauauuugucacugcaccucaugaaucaacuggagguaucauuggggugaauagaaaaggccagguguuaucagugaguguugaagaggaccacauaaucccauauaucaauaauauauuacaaaauccagaucuagccuuacgcauggcaguuagaaauaaucuagcuggagcugaagauuuguuuguuaaaaaauucaauaugcuuuuccagaaugggcaguaugcugaggcugcuaaaguggcagccaaugcucccaagggaauacugagaaccccacaaaccauucagcaguuccaacaaauaccaaauccgcaagggcaaacaucaccucuuuugcaauauuuuggaauuuugcuugaucagggucaauugaacaaguaugaauccuuagaauuaugcagaccuguucuggcucaaggaagaaaacaguuaauggaaaaauggcugaaagaagauaaacuagagugcucugaagaacucggagaucuaguaaaacaaacagacccaacucuugcacucucuguuuauuuaagagcuaauguuccaaacaagguuauacaaugcuuugcugaaacuggacaauuccagaagauuguacuauaugcaaaaaaaguagguuauucuccugacuacauuuuccugcuccgaaauguaaugcguguuaauccugaucaagguguuagcuuugcucaaaugcuuguucaagaugaagaaccacuggcugauauaaaccagauuguugauauacuuauggaacaaaauauggugcagcagugcacugcuuuucuuuuagaugcccuuaagaauaaucggccuucagaagguccauuacagaccaggcuacuugaaaugaauuugauuucugcaccucagguugcugaugcuauacuugggaaccaaauguuuacacauuaugauagagcccacauugcccagcuuugugagaaggcugguuuacuccagagagcguuggaacauuacacagaucuuuacgauauuaaacgagcuguuguucacacucaccuccuuggcccugauuggcuugugggauacuuugguacccuuucuguugaagauucacuugaauguuugaaagccaugcuaacugcaaauauucggcagaacuugaauauauguguucagauugcuaccaaguaccaugaacaacuaacaaccaaggcuuuaauagaucuuuuugaaucauucaaaaguuaugagggauuguuuuauuuccuuggcucaauagucaauuucagccaagaucaagaaguucauuuuaaauacauccaggcagccuguaaaacagggcagauaaaagaaguugaacgaauuugccgugaaucuaauugcuauaauccagagagaguuaaaaauuuuuugaaggaagcaaaguugacagaucaauuaccacuuauuauuguuugugaucgguuugauuuuugucaugauuugguuuuauauuuauaccgaaacaauuugcaaaaguacauugaaauuuaugugcaaaaggucaauccaucucgguugccaguugugauaggaggauuauuagauguugauuguucugaagacauaauuaaaaauuugaugaugguuguuagaggucaauuuucaacugaggagcuuguugcagaaguagaaaagcgaaaucgauuaaaacuucugcuuccuuggcuggaaacucguguucaugaaggcuguguugagccugcuacucauaacgcuuuagcaaagauauacauugauagcaauaauaauccagaacgauucuugagggaaaaucaguauuaugauagcuguguuguaggaaaguacugugaaaaacgagauccacauuuggcauguguagccuaugaaagaggucaaugugauagagagcucaucaaugucuguaaugaaaauucucucuuuaaaucagaagcaagguacuugguuagacguaaagacccugaauugugggcugaaguucuuaaugaaaacaauccuuacaagagaccauuaauugaucagguuguucaaacagcucuuucggaaacucaagauccugaagauaucagugugacugucaaagcuuucaugacagcugauuuacccaaugaacuuauugaacuccuagaaaaaauaguucuagacaauucaauauuuagugaucaccgcaaucuucaaaaucuucucauucuuacugcuauaaaagcugaccguucaagagugauggaauacauuaaccguuuagauaauuaugaugcaccugauauagcaaauauugcuauaaauuaucaauuauaugaagaagcauuugcaauauuuaaaaaguucgacguuaauacuucugcuauccagguucuaauugaaaaugugaacaaucucgauagagccuaugaauucgcagaacgcuguaacgagccagcuguguggagucaauuagccaaagcucaacugcaacauggccuuguaaaagaagcaauagauucauucauaaaagcugacgacccuucugcauauguugaugugguggaaacagcucacaaaacagaaagcugggaggauuuaguccgcuauuuacaaauggcaaggaaaaaggcuagagaaucuuacauugaaagugagcugauuuaugcuuaugcucgcacuaaccgauuggcugaucuugaagaauuuaucucagguccgaaucaugcugauauucaaaagauuggugauagguguuuugaugacaagauguaugaaccagcuaaacugcuuuacaacaauguuucaaacuuugcuagacuagcuauaacacuaguucauuuaaaagaauuucaaggagcuguggacagugcaaggaaagccaacaguacaagaacuuggaaagaagucuguuuugcuuguguggauagugaggaauucagauuagcucagaugugugguuugcauauugugguucacgcagaugaacuugaagaccuaaucaauuauuaucaggaccgaggauacuuugaagagcuuaucaauuuauuggaagcugcacugggguuagagcgugcucauaugggaauguucacagaauuagcuauacucuauuccaaguauaaaccagcaaaaaugagggaacauuuagaauuauuuuggucucgaguuaauauucccaaggucuugagagcugcugaacaagcucauuuaugggcagaacuuguuuuucuguaugauaaguaugaagaguaugauaaugcugugucugcaaugaugaaucacccuacugaggcuuggagagaaggacauuuuaaggacauaauuaccaagguugccaacauugaacuauauuacaaagcaauacaauuuuauuuggauuauaaaccucuccuauugaaugauauguuauugguauuagccccaagaauggaucauacaagagcaguaaacuucuuugccaagguuaaccauuuacaauugguuaagccuuaucuucgcucaguacaaucauuaaacaauaaagcaauaaaugaagcucuaaacaaucuucucauugaagaggaagacuuccagggugucagaacaucaauagaugcuuuugauaauuucgacaauauuguauuagcucaaaagcuugaaaagcaugaguugaucgaauucaggaggauagcagcuuaucuauauaaaggaaauaaccgauggaagcagaguguucaguuaugcaagaaagauagauuguucaaggaugcaauggaguaugcugcagaaucaaagaacucagaaguugccgaagaacuuuuagcaugguucuuagaaaaaggaaaucaugacuguuuugcugcuugucuguuccaauguuaugaucuucuucauccugauguuauucuagaacuugcauggcgacauaauaucauggacuucgccaugccuuauaucauucaagugacaagagaguacauuuccaagguugauaaauuggaagaaucugaagcaagaagguuagaagaaagagcagaacaggaucacaaaccuaugaugaugccugagccacagcuaauguuaacugcuggcccaggaaugaucggaccugguuuuucaccugcuuauccuaacacuuuuaccacuggcaugccuuaucaagguuauggcauguag

SEQ ID NO: 476 - RNA, 471 nt, Piezodorus guildinii
augcagauuuucguuaaaacccucacggguaagaccauuacccuugaggucgagccuucugauacuauugaaaaugugaaagcuaaaauucaagauaaggaagguauuccuccugaucagcagcguuugauuuucgcuggcaaacaguuggaagauggcagaacucugucugacuacaacauucagaaagaaucuaccuugcacuuagugcuaaggcuuaggggaggugcaaagaaacguaagaagaagaauuacuccacucccaagaagaucaagcacaagaagaagaaggucaaacuagcugugcuuaaauauuacaagguugaugagaaugguaaaaucagcagguugaggagggagugucccucugaacagugcggugcuggugucuucauggcugccauggaggacaggcacuacuguggaaagugugcauacacccuugucuucaauaagccugaagauaaauaa

SEQ ID NO: 477 - RNA, 582 nt, Piezodorus guildinii
auggucaaucggaggguuccgucugugcauaguaaaaccuaugucacaccaaggcguccuuaugaaaaggcucgucuagaccaggaguugaggauuauuggagaauaugggcuuagaaacaagcgugaaguauggagggucaaauauacccuugcuaaaaucaggaaagcugcccgagaacuucuuacucuugaugagaaggauccuaagagguuguucgaagguaaugcacuuuugaggagauuaguaagaauuggaguauuagaugaggcuaagaugaaacuugauuacguuuugggucuuaaaguugaagauuucuuggaaaggaggcuucagacucagguuuucaaauugggucuugcuaaaucaauucaccaugcuaggguuuugauuaggcagaggcacauuagagugaggaagcagguugucaacauccccagcuuuauugugagguuggacucacagaaacacauugacuucucacugaagucuccauucggugguggccgcccuggccguguaaagaggaagaacucccgcaagggaaccaccgcugccgcugcagaagaagacgaagauuaa

SEQ ID NO: 478 - RNA, 834 nt, Piezodorus guildinii
auggcaggagucuuagccacugagagaacucuuccuggguuuucuuuugaaaauugucgaaggaacucccucuuguugcagcaaggauuuaaaccgcccacugcgcagaagacugguacaacaauuguuggaauaauuuauagagaugggguuauucuuggagcugauacuagagcuacagaagguagcacaguugcugacaagaauuguuccaagauacauuuucuagcugacaacauuuauugcuguggugcugguacugcugcugauacagaaaugacgaccaugacaaucaugucacaauuggaauuacaucgucucaauacuggucgcccugucagaguuucuacagcaaagcagcuuuugaaacaguuacucuucagguaucagggccacauuggagcagcucuuguuguugguggggucgaugugacuggaccucuucuuuauucuauacauccucauggcuccucagaaugcuuacccuucacaacuauggguucugggucucuugcugcuaugacaguacuugagucaucauggaagccugauuuaucugaagaagaagguaaaguaauaguccgcaaugcuauugcugcuggaauauuuaaugaucuugguucagggagcaauguagacauuuguaucauccggaaagguucuguugauuauauccgucccuuugauguugccaaucucaaaggacaaaagcaaaauaauuaucguuuucggcgaggaacuacgggaguucuuucaacaaggauaauuccuuuggugacagagucagaagaaauaaaaaaaacugaaguggaauccauggauacaucugcuuga

SEQ ID NO: 479 - RNA, 759 nt, Piezodorus guildinii
aagagagcaaggauagugacucucaccagguuauuguacuuuugcuugguaaucauggguucugagagauacaguuuuucucugacuacauuuaguccuucugggaaauuaguucaaauugaguaugcucuugcugcagucgcagcuggagcuccaucaauugguaucagagcaucuaaugggguuguauuggcuacugaaaacaaauacaaaucaauuuuauaugaagaacauacuauucaaaaaguagaaaugauaacuaagcacauaggaauggucuacagugguaugggaccugauuauagauuacuuguuaagagagcaagaaaaauggcgcagcaauaucaguuaguuuauggcgagccuauuccuaccgcacaacuuguccaacgaguagcuaugguuaugcaggaguacacucagucaggaggugugagaccguuuggaguuucuuuacucaucgcuggcugggauggagauaaaccuucucuauuucagugugauccaucuggagcauacuuugccuggaaagcgacugcuaugggaaagaauuuuguuacaggcaaaacuuuucuagaaaagagguacagugaaacuuuggagcuagaugaugcaguacauacggcaauucuuacucucaaggaaaacuucgaaggacaaaugacuucggacaauaucgagguuggaguuugcgaugcccaaggcuucagaguuuuagacccaacuacugucaaggauuaucuugcuaauauuccauaa

SEQ ID NO: 480 - RNA, 786 nt, Piezodorus guildinii
gcaacugcuucuaaggcagcuccagcaccagcugcuaaagcagcugcagccaagucagccgcccccaguucugcuaagccagcuucagccaagcaacccgccccagcuccuaaagcugcacagccuaaagcccaggcuaagccugcagcucaacaacagaaaccagcuaaaccacaacagcaagggaaagcugcagccccagcgaaagcacaagcuaaaccugcagcgcaggccaagccugcugcuccagccgcagcucccaaacaaccagccgcuccagcagcagcagcuggaacccaaccagccgcugcagcacccaagaaagcuccaucaggugcaguuaagaaagcagcaacugccccuaagaaaagucaaaauuuacagaaaaaaucucaccaagguguuaggaaacaaguguuaaaaggaaaaggacaaaaaaagaaaaaagucucauuaaaguuuauaauugacuguacucaucccuaugaggacaaaaucauggaugucgccaacuuugaaaaguauauucaggagagguuuaaaguuaaugguaaaaccaacaacuuaggcaacaauguuacuuuagaaaggaacaagaugaagauaacuguuacuucugauguacauuuucccaaaagguauuugaaauauuugacuaagagguaccuuaagaagaacaaucugagggauuggcucaggguuguaucaaguucuaaagacaccuaugaacuaagguacuuccaguucaacagccaggaugaugaugaugaagaggacaaugauuaa

SEQ ID NO: 481 - RNA, 351 nt, Piezodorus guildinii
augacuaagaaaaggaggaauggaggaagaucaaaacauggcaggggucauguccaagcagugcguuguaccaacugugcucguuguguuccuaaggauaaggcuauuaagaaauuuguuauucguaacauaguugaagcugcugcugugagggauaucacagacgcuagcguauacuccucauaccaauugccgaagcucuaugcuaaacugcauuauuguguaucaugcgcuauccacucuaaaguagugcguaaucguucuaaggcugagagaagaauuaggacaccuccucagcgaaacuucccaagggauaugaugcgccaagguggaccccaaauaaggaaguaa

SEQ ID NO: 482 - RNA, 900 nt, Piezodorus guildinii
auggguuucguuaaagucgugaaaaauaaacaauacuacaaaagguuucaaguuaaauuuaagaggcgacgagaagguaaaacagauuauuaugccaggaagagauuaauuguacaggauaaaaauaaguacaauacuccuaaauaucguuugauuguccgccuuuccaacaaagacauaacaugucagguugcuuauucucgcauugaaggugauaaaauauugugugcugcauacagccaugaacuuccucauuuuggaauuaaaguaggauuaaccaacuaugcugcugccuacuguacuggucuucuuuuggcaaggaggcuucuucaaaaacugaaguuggaugguuuguaugaagguacaaccgaaguaacaggugaugaguacaauguagagaauuuagaugaagguccaggugcuuuccgcuguuacuuagauguugguuuaaugaagaccagugcuggagcccguguuuuuggagcacugaaaggugccguugauggaggucuuaacaucccucauagcaugaaaagauuuccagguuaugauucugaaagcaaagaguucaaugcugaagugcacagaaaacacauuuuuggaauucacguugcugaauauaugaggcaguuguccgaaucugacgaagaagcuuauaagaagcaguucaguguuuacaucaaaaauggcauuguuccugaugcuauugaagacauuuacaagaaggcacaugcugcaaucagggaaaauccugccccaagaccacguguaaggaguaaggagcccaucaagaagagauggaaucgugcuaaacuuacucuugcagaaagaaagaauuguauugcccaaaagaaagcagcauucuuaaagaaaauacaggccggcgaugucgaugccuaa

SEQ ID NO: 483 - RNA, 1710 nt, Piezodorus guildinii
augcaaauuuuuguuaagacccuuacaggaaagaccauuacucuugaaguugaaccaucugauacaauugaaaaugucaaagcuaaaauucaggauaaggaaggaauucccccagaucaacaaagauuaaucuuugcugguaaacaguuggaagauggccgcacccuuucugauuacaauauucagaaggaaucuacucuucauuuggucuugcguuugagagguggaaugcaaauuuuuguuaaaacucuaacuggaaagacuaucaccuuggaaguugaaccaucugauaccauugagaauguuaaggccaaaauucaggauaaagaaggaauuccuccagaucagcaaaggcuuauuuuugcuggaaaacaacuagaagauggccgcacucugucagauuacaacauucagaaagaauccacccugcaucuuguacuucguuuaagaggaggaaugcaaauuuuugucaaaaccuuaacuggaaagaccaucacauuagaaguggaaccaucugacacaauugaaaaugucaaagcuaaaauucaagauaaagaaggcaucccuccagaccaacaaagauugauuuuugcaggaaagcaauuagaagauggucguacuuuaucagauuauaacauccagaaagaaucuacacugcauuuaguucuacguuuacguggaggaaugcaaauuuuugucaagacucuaacuggaaaaacuaucacucuugaaguugagccuucagauacuauugagaauguuaaagcuaaaauucaggauaaagaaggaauuccgccagaucagcaaagacugaucuuugcuggaaaacaguuggaagauggccguacgcuuucugauuacaauauccaaaaggaauccacauugcaucuuguucuuagacuucgaggagguaugcagaucuuugugaagacauuaacaggaaagacuaucaccuuagaaguagaaccaucugauacuauugaaaauguaaaggcaaagauucaggacaaagaaggaauucccccagaucagcagagauuaauuuuugcuggaaagcagcuugaagauggccguacucuuucagauuacaacauccagaaggaaucuacguuacaucuaguccuucgucugcgaggugguaugcagauuuuuguaaaaacucugacagggaaaaccauuacuuuagaaguugaaccaucagauacuauugagaaugucaaagcaaaaauucaagauaaagaaggaauucccccagaccaacagagauugauuuuugcuggcaaacaacucgaagauggcagaacuuugucugauuacaacauccagaaagaaucaacccugcaucuaguacuacguuuaagaggaggcaugcagauuuuugucaagacacucacuggaaagacuaucacucuagaaguugaaccaucugauacuauugaaaacguuaaggcuaaaauccaagacaaagaaggaauuccaccagaccaacaaaggcuuauuuucgcuggaaaacagcuugaagauggcagaacuuugucugauuauaacauccagaaagaaucaacccuacauuuaguauugcgucugcgaggagguaugcagauuuuugucaaaaccuugacugguaaaaccaucacccuggaaguagagccuucagauacuauugagaauguuaaagcuaaaauucaggauaaagaagguauuccacca

SEQ ID NO: 484 - RNA, 615 nt, Piezodorus guildinii
auggcggaugaugaagcaaagaaggcaaaacaggccgagauugagcggaagagagcagagguccgaaagaggauggaggaggccucaagaggcaagaaggccaagaaagguuucaugacgccagacaggaagaagaaacuccgacuucugcugagaaagaaagcugcugaagaacugaagaaagaacaggaaaggaaagcagccgagagaaggaggaucauugaggagcgcuguggaaagauuugugacguugacaacgccagugaagaaaaauugaagaaaaucugcucugauuaccaccagcgaauuggacgguuggaggaugaaaaauuugacuuggaauacguuguaaaaaagaaagauuuugagauugcggaucuuaacagccaagucaaugaucuucguggaaaguucguuaaacccaccuugaaaaagguuuccaaauaugaaaauaaauuugccaaacuucagaagaaggcugcugaauucaacuucagaaaucaacucaaaguugugaagaagaaggaauuuacccuagaagaagaagacaaagagaaaaaaggaggcaucgucgacugguccaagaaggaugaaaaggcaaagguagaagcauga

SEQ ID NO: 485 - protein, 117 aa, Piezodorus guildinii; identical to SEQ ID NO: 325

SEQ ID NO: 486 - protein, 226 aa, Piezodorus guildinii
MSLSDADVQKQIKHMMAFIEQEANEKAEEIDQKAEEEFNIEKGRLVQNQRLKIMEYYERKEKQVELQKKIQSSNMLNQARLKALKIREDHVRDVLDEARKRLLQSVKDEARYKDILQKLMLQGLFQLMESDILVRTRETDGPVVSSVFPDVLVKYKEASGKDLQLKLDTESYLPSECAGGIELYTARGRIKIVNTLESRLDLISAQLLPQIRTSLFGRNANRKFAD

SEQ ID NO: 487 - protein, 118 aa, Piezodorus guildinii; identical to SEQ ID NO: 327

SEQ ID NO: 488 - protein, 430 aa, Piezodorus guildinii
MSTSKTEEKPMWDERMEQALGEEIMRMSTDEIVSRIRLLDNEIKIMKSEVMRVSHELQAQTEKIKENTEKIKVNKTLPYLVSNVIELLDVDPEETEEDGAVVDLDARRKGKCAVIKTSTRQTYFLPVIGLVDAEKLKPGDLVGVNKDSYLILETLPAEYDARVKAMEVDERPTEQYSDIGGLDKQIQELIEAVVLPMTHKEKFENLGIHPPKGVLLYGPPGTGKTLLARACAAQTKSTFLKLAGPQLVQMFIGDGAKLVRDAFALAKEKSPAIIFIDELDAIGTKRFDSEKAGDREVQRTMLELLNQLDGFSSTADIKVIAATNRVDILDPALLRSGRLDRKIEFPHPNEDARARIMQIHSRKMNISVDVNFEELARSTDDFNGAQCKAVCVEAGMIALRRGAGVVTHEDFMDAILEVQAKKKANLNYYA

SEQ ID NO: 489 - protein, 128 aa, Piezodorus guildinii; identical to SEQ ID NO: 329

SEQ ID NO: 490 - protein, 395 aa, Piezodorus guildinii
MTASQAMEPNREKALQDYRKKLLEHKEVEVRLKEMRDQLKDLTKQYDKSENDLKALQSVGQIVGEVLKQLTEEKFIVKATNGPRYVVGCRRQLDKLKLKSGTRVALDMTTLTIMRHLPREVDPLVYNMSHEDPGDVTYSAIGGLAEQIRELREVIELPLLNPELFQRVGITPPKGCLLYGPPGTGKTLLARAVASQLDANFLKVVSSAIVDKYIGESARLIREMFNYARDHQPCIIFMDEIDAIGGRRFSEGTSADREIQRTLMELLNQMDGFDSLGQVKMIMATNRPDTLDPALLRPGRLDRKIEIPLPNEQARLEILKIHASPISKHGDIDYEAVVKLSDNFNGADLRNVCTEAGLFAIRAEREYVMQEDFMKAVRKVADNKKLESKLDYKPV

SEQ ID NO: 491 - protein, 417 aa, Piezodorus guildinii
MAGAMLFERTVSSRDRDNSRILPTSSRNVDDDNDEEDIRNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVDSPKALVALKYMLLSKIMLNTPEDVQQLVSGKLALKHAGKDIDAMKSVAQASHKRSLADFQITLKNYKKELEEDPIVRAHLGTLYDNMLEQNLCRIIEPYSRVQVDFISKSIKLPLPQVEKKLSQMILDKKFNGILDQGEGVLIVFEDAVVEKTYEMALEVINSMGKVVDTLYQKAKKLS

SEQ ID NO: 492 - protein, 159 aa, Piezodorus guildinii
MTNSKGYRRGTRDLFSRGYRKHGVIPLSTYMKVYKVGDIVSIKGNGAVQKGMPHKSYHGKTGRVYNVTPRALGVIVNKRVRGKILPKRINIRIEHVNHSKCREDFLKRVRENERLRKEAKEKGIRVELKRQPAQPRPAHLITVKEPPIMLAPIPYEFIA

SEQ ID NO: 493 - protein, 199 aa, Piezodorus guildinii
MSSLKLQKRLAASVMRCGKKKVWLDPNEINEIANTNSRQNIRKLIKDGFIIKKPVAVHSRARVRKNTEARRKGRHCGFGKRKGTANARMPAKVLWVNRMRVLRRLLKKYREAKKIDRQMYHDLYMKAKGNVFKNKRVLMEFIHKKKAEKARSKMLRDQAEARRQKVKEAKKRREERITLKKQEILQSYQREDEAATAKK

SEQ ID NO: 494 - protein, 261 aa, Piezodorus guildinii
MVMNLFIATGHMGLFRRLLISCSQPSLSEAAPIQPALAKYPESSSLTLPCFPKPSFTMGAYKYIQELYRKKQSDAMRYLLRIRVWQYRQMTKMHRVVKPSRPDKARRLGFKNKQGFCIFRIRIKRGGRKRPVPKGATYGKPKSHGVNQLKPTRSLHAMAEEKVGRRCSGLRVLNSYWVAQDARYKYYEVICIDPAHKAIRRDAKANWICDPVHKHREMRGKTSAARKSRGLGKGHRYSQTKGGSRKAAWVRRNTLQLRRKR

SEQ ID NO: 495 - protein, 376 aa, Piezodorus guildinii; identical to SEQ ID NO: 336

SEQ ID NO: 496 - protein, 505 aa, Piezodorus guildinii
MVLIAAAVCTKAGKTIVSRQFVEMTKARIEGLLAAFPKLMSSGKQHTFVETDSVRYVYQPLEKLYMVLITTKASNILEDLETLRLFSRVIPEYCRNMEESEITENAFNLIFAFDEIVALGYRESVNLAQIRTYVEMDSHEEKVYMAVRQSQEREAKNKMREKAKELQRQRLEAGKKGYKTPSIAGFGSSSTYTSPVVETVDLPKPSYTPAKPVLSAKAMKLGGKSRDVESFVDQLKSEGENVISQVAVNKPVAAKLASSPNIHMEEVHLKQEEKLMVSVGKDGGIQSFELHGLVTLRITDEKYAKIKVYLDNKDKRGIQLQTHPNVDKELFKLKSQIGLKNPSKPFPLGTDVGVLKWRYQSQDESALPLTINCWPSENGQGGCDVNIEYELEHAHLELNDVTINIPLPIGCSPVVAECDGEYKHESRRNLLQWVLPVIDRSNKSGAMEFSASSAMPSDFFPLIVSFTSKQPYADLKAVEVLHVDDETPVKFSSETLFYTERYEIV

SEQ ID NO: 497 - protein, 395 aa, Piezodorus guildinii
YDGPPGMDPEGIIESNWDEVVDNFDDMNLKEELLRGIYAYGFEKPSAIQQRAIIPCVRGHDVIAQAQSGTGKTATFSISILQQIDTSARECQALILAPTRELAQQIQKVVIALGDFMGAMCHACIGGTNVREDMRKLEMGVHVLVGTPGRVLDMISRRALKTNTIRIFVLDEADEMLSRGFKDQIHDVFKNLNHEVQVILLSATMPSDVLDVSTCFMRNPIRILVKKEELTLEGIKQFFVFVEREEWKLDTLCDLYETLSITQAVIFCNTRRKVDWLTENMHNRDFTVSAMHGDMEQRERDIIMRQFRTGSSRVLITTDLLARGIDVQQVSLVINYDLPSNRENYIHRIGRGGRFGRKGVAINFVTEEDKRSLNDIEQFYNTRIEEMPMNVADLI

SEQ ID NO: 498 - protein, 263 aa, Piezodorus guildinii
MARGPKKHLKRLNAPKSWMLDKLGGVFAPRPSSGPHKLRESLPLVIFLRNRLKYALTNTEVTKIVMQRLIKIDGKVRTDPNYPAGFMDVISIEKTGEFFRLIYDVKGRYAIHRITGDEAKYKLCKVKRVQTGPKGIPYLVTHDARTIRYPDPLVKVHDTIQLDIATGKIIDIIRMESGNLCMITGGRNLGRVGTVVNRERHPGSFDIVHIKDASGHTFATRLNNVFIIGKGSKAYVSLPKGKGVKLSIAEERDKRLAAKGASS

SEQ ID NO: 499 - protein, 802 aa, Piezodorus guildinii
MADMKSNEDLSTAILKKKDRPNRLIVEDAVNDDNSVVALSQAKMDELQLFRGDTVQLKGKRRKETVCIVLSDDTCPDEKIRMNRVVRNNLRVRLSDIVSIQACPEVKYGKRIHVLPIDDTVEGLTGNLFEVFLKPYFLEAYRPIHKDDTFVVRGGMRAVEFKVVETDPAPYCIVAPDTIIHCEGNHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEEQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKREKSRLDGATRMDMDDEDPVPEITREHFEEAMRFARRSVTDNDIRKYEMFAQTLQQSRGFGTNFRFPASSNIPSAPGGGGTETNNFPDDGDDDLYN

SEQ ID NO: 500 - protein, 134 aa, Piezodorus guildinii
MTIEDESGPSGDSVDINTALKEVLKGVVRNGIIVHGLRESAKALDKRQALLCVLAENCDEPMYKKLVQALCSEHQIPLVKVDSNKKLGEWSGLCKIDKTGNPRKVVGCSCVVIKDWGDDTPHLDVLKDYMTESM

SEQ ID NO: 501 - protein, 124 aa, Piezodorus guildinii
MSGRGKGGKAKGKAKTRSSRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKSS

SEQ ID NO: 502 - protein, 1498 aa, Piezodorus guildinii
MNLRAVIIVLVAVSALPGYAQENGTNLLPRTKRNPTKLRHSRRFAERMPTSSYYDDYPPITNSQNQENHKPIFTNCSMYQPSVPEELTHTTTVIQVTAADKDPPEAGGKVTYTFVATPQESQKFNIDPETGVITTRHSFDRDEPNREKEVYLTVRATDNGRPQLDDVCTFKIIIEDINDNPPVFDKVDYQESVPQDLPPKREVMRISATDVDDGNNSIVMYSLEPRSADLSTKSYFQIDSKTGVITLDRAIDRDPGYKFKLRATATDHGDIPKSAVINLDIQVVESNKKAPVFTSIPASPIVLLENFTDFTENIATLTAMSNDEKAPVFELVTGRTEQTNKYSTFRLESDANTAHIRLARRMDYESIAEYTLTIRIQNKFNLASETSINIQLEDVNDNIPAFTEVVSGVVLENEPAGTPVMQVRAIDADSTTAHNQVTYELADNTENFAIDRYTGNITTKKMFDREEQDFYNVKVIAKDNSPSALYKTGVPNEGQQVFRIEIADKNDHPPKFTEAVYVAEAIPENANTNARVTQVNAQDNDTASLVHYSIFYGNENDAFVIDEITGEIRVNKNLDYETRTNYTLKVKAFDGAYEDNCEVHIKIENVNDNPPVFVSYQKTITIMEEELFPGCIAQLEAYDPDIPDRSLPQHILYFVVKEQQSKWLNINKKGCLSLIKPLDRDPPNGTESWQVLIGAKDEDGGPTGVQQTTEVIIMLTDINDNAPYLEMSQPVIWTENEPPGDIVKLNAKDNDGPENGPPFTFNIAPSASTEIQTKFTISGSTLKSLVRFDREERKSYFVPIAITDSGNPSLTGTSTLHVVIGDVNDNPMKSGYSEIFVYNYKGEAPDTDIGRVYVEDPDDWDLPDKHFEWAGMAGPYFDLDPKTGMITMLQGTVDQSYILNFTVFENATRYFSAHSVTATVNVTVKEIPEEAVDKSGSVRLVGITAEEFVEADSNGISKRTMFRKYLAKFLNITEENVDVFTVLHSPHNANTSLLDVRFSAHGSPYYSPEKLNAAVSVHNAELEKELGVAILMVNIDECLVERQYCEGSCINFLNKSREPIAVYTNTTTFVGVRAVVDPFCNCEVPPRPVCHNGGTLVNNDKCECEPGFEGPHCEILSIGFSGNGWALYPPLESCADSHLSLELRSNKKDGLVFYVGPTKPNRLMNVQDFISFEVVDGYPVLLLDFGTGTVKLDPKQIRLDDGEQHRIDIIWSRTTIELQVDNCKLPSCLSLKLKAGDNEFLNVNGPLQVGGSFVDFNYLDNHMNWTHKPSRVGFSGCVKNFTFNNKLYNLGMPGYSKNADIGCNAGVAVAVSFGIDPSFIIAIIICLAILLILLLAVVVHRRKTDDLYKDTDDIRENIINYEDEGGGEGDMTAYDLNVLRLMYNDAIQDKPLPDHMNSRPDEVPDICGFLDGKKQSVDNDPETNPFDDVRHYAYEGDGNTTGSLSSLASGTDEGDLNFDYLSNFGPRFRKLADIYGKDSSDDDDDDDNYQTTASESWC

SEQ ID NO: 503 - protein, 387 aa, Piezodorus guildinii
MSDEEYSESEEETVPEPEPQKKTERRQSEKGDGDPEFVKRQEAKTSALDEQLKDYIAEWRKQRAKEEEDLKRLKEKQAKRKVMRAEEEKRLAEKKKQEEERRVREAEEKKQRDIEEKRRRLEEAEKKRQAMMAALKDQSKSKGPNFTISKKEAGLNLSSAQIERNKTKEQLEEEKRISLSIRIKPLNIENLNIDRLRLKAIELWDCIVKLETEKYDLEERQKRQDYDLKELKERQKQQLRHKALKKGLDPEALTGKYPPKIQVASKYERRVDTRSYDDKKKLFEGGWETLTAEELEKIWKSRYEQFTKRKHAKLPKWFGERPGKKKDAPESPEEEEVKPTDDDVEPVYAEEEEEGAEEEAEEEEEEEEEAEEEEEEEEEEEEEEEEE

SEQ ID NO: 504 - protein, 283 aa, Piezodorus guildinii
MDAIKKKMQAMKLEKDNAMDRALLCEQQARDANLRAEKAEEEARSLQKKIQAIENDLDQTQEQLMQVLQKLEEKDKALQNAESEVAALNRRIQLLEEDLERSEERLATATAKLAEASQAADESERQRKVLENRSLADEERMDALENQLKEARFLAEEADKKYDEVARKLAMVEADLERAEERAESGESKIVELEEELRVVGNNLKSLEVSEEKANQREEEYKNQIKTLTNRLKEAEARAEFAERSVQKLQKEVDRLEDELVHEKEKYKYICDDLDQTFSELVG

SEQ ID NO: 505 - protein, 262 aa, Piezodorus guildinii; identical to SEQ ID NO: 346

SEQ ID NO: 506 - protein, 220 aa, Piezodorus guildinii; identical to SEQ ID NO: 347

SEQ ID NO: 507 - protein, 236 aa, Piezodorus guildinii
MTCATPISKKKKFVADGVFRAELNEFLTRELAEEGYSGVEVRETPSRTEIIIMATRTQSVLGEKGRRIRELTSVVQKRFNFQPQSLDLYAEKVPTRGLCAIAQAESLRYKLIGGLAVRRACYGVLRFIMENGAKGCEVVVSGKLRGQRAKSMKFVDGLMIHSGDPCNEYVNSATRHVLLRQGVLGIKVKIMLPWDPTGKNGPKNPLPDNVCVVNPKDEVIPSDIKTMGIELHPPAI

SEQ ID NO: 508 - protein, 117 aa, Piezodorus guildinii
MSKAELACVYSALILADDDVAVTGEKIQTILKAAGVDVEPYWPGLFAKALEGINVKDLITNISSGVGVGGGAPAAAAGGAAPAAAAAPAGGDKKKEEKKKEESEPESDDDMGFGLFD

SEQ ID NO: 509 - protein, 218 aa, Piezodorus guildinii
MSFLSKVFLGKKEEKAPTASEAIQKLRETEDMLIKKQDFLEKKIESELSLVKKNGTSNRRVAIQALKRKKRYEKQLQQIDGTLATIEMQREALEGANTNTAVLQTMKFAADALKTAHKHMDVDQVHDMMDEIAEQQDVAKEISEAISNPVAFGNDIDEEELEKELEELEQEELDRELLGTGPTADQLPDVPATQLPAKPKPIASEDDEELRQLQQWAT

SEQ ID NO: 510 - protein, 151 aa, Piezodorus guildinii
MGRMHAPGKGISQSALPYRRSVPTWLKLSPEDVKEQIYKLGKKGLTPSQIGVILRDSHGVAQVRFVTGNKILRIMKAMGLAPDLPEDLYFLIKKAVAIRKHLERNRKDKDSKFRLILVESRIHRLARYYKTKGGLPPNWKYESSTASALVA

SEQ ID NO: 511 - protein, 430 aa, Piezodorus guildinii
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFAPTRVWRRWHRKVNVNQKRYAMVSAIAATGVPALVMSKGHMVNEVPEIPLVVTDKIQEYTKTKQATIFLHRIKAWSDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSEEIKSVLKAPRKTIVRRVRKLNPLRNTRAMLKLNPFAAVLKRKAILADRKLKLERAIERSKKEGIELTPHQKRYVAMLERRKAQIKAAKAAKPKKVKKPKAEKTEAAEAKKASVTKKPAKKATTAAAPKPAKK

SEQ ID NO: 512 - protein, 229 aa, Piezodorus guildinii
MLKSQRPWHKVFSCSAFRNPSILSEMTGFSDKPILIDGKGHLLGRLAAIVAKAALNGNRIVVVRTEQINISGNFFRSKLKYLSFLRKRCNVNPARGPFHFRAPSKILYRTIRGMVPHKIERGKAALRRIKLFEGIPPPYDKRKRVVVPTAMRVLCLKPGRAYCHLGRLSSEVGWKYKDVVRALETKRKVRAVFDIRKRNSLKKLTKQAKEKMSKANANYTAVINSYGYR

SEQ ID NO: 513 - protein, 1195 aa, Piezodorus guildinii
MSPPGHLPGVVGCEVGEPLSWNKMSGSASGSSSKKRKKPENKPQSQINKCLNEKRRREQENIYIEELAELISASFTDMSSLSVKPDKSAILQETVLQIKTIKGRTATSDAVQQGEVSSSKPTILANEVFGPLLLEALDGFLFIVNPEGKVEFCTENITQFIKYCREEVLGQPVYNIIHHGDHARFSSWLLPMSWSNDYQPPRPRTFNCRFLIKPPPDTTVEEKQQRPSKYENMQISSTQLPQSSGIDKDDDGSSESGPCLMCIARRIPPNEKPAGSPIEQFTMKLNTSGRIIKIDNTGVSAPYSQYFSKQDLMHRNLDELVQSSDVPKVVGHVKDALTTGQSSTSIYKLQIGHDKYVNVQTKFKLFKSANRQMENDFIMATHSIFGDNEANLEIGSPAGNSNQSGSGNNNTNQQQQQQMQPQQQQSSSTGGVGGPLIANGANRDLGNTITLNTSTSFGSVTLNSADIDILSSFDFPSTTWPEISSDLEWKKSEFRTPVQSPVLPNPPAQSPTATPFSTPYSLSPIHEDAPEEDSVRLRNLLTTKRPSTESDDGGGGNIAQRNNNRILKNLLNQEDEESQPQDSKPPNNMLLKLLNTQSDDDDVEARAGLKKQNELLHQLLKEEDNNQDNQQSGDDGLLKSLGFRGEGSEESRGGRKRPSSDESEDQPGSKRSSSSLLDAVPPPPTPSAPSAASGKSRLWEKNQMLASLLAKRPTTPASIPPIPASVISATPQDKLQRLVKHPPTGWSGGSVQAGAGSPGQSRSGRSPGYTGANTWDSASSDPVLSDILDQVIEIVPDVNTDAPVLMNMINSLEAETQPSVQQQFASQQEFLNEKMAINAIQKSLMLCESAVKSPTYQTTMSQGSPQAQPQPQPQQQSQPQQQQQQQQQFHPPPMYQQRQRFPIQQQPQIRQQQQFSISPLLMAQRKMLNHNQQMQQKQRLLQLQQQQQLVIPSNATAQNADPALHNIDSLINNTVAPNVSLQRSSSVPDSQLSPVGSYPGLGSVPSPGQRRPFSPVNGGMTSFSSGGGAGPPVSGSGPQARLSPSSLQGYQQQPQLSPRLTQGQQNYGGGGASWSQQNSRLSVQQQENPVLNAQLTSGGRGYARNTSAGLPPVRSLAGPQRFPTAADQQAGAASYQFRLQRQVSAPPPQQSSPNPQLPGGNNGVTEYVRQELRAMVGARTSAGGRPQVPGSLPLP

SEQ ID NO: 514 - protein, 174 aa, Piezodorus guildinii
FQKILLGRTGNNNVGFFEVLHESSVRRIINFIRIHQSKMGKIMKAGKVVLVLSGRYAGRKAIVLKTCDEGTQEKAYGHAIVAGIDRYPRKVHKRMSKTKIHKRSKIKPFLKVMNYNHLMPTRYTVSEIAPDQKVVTKDLKDPMKKKKIRFQVRVKFEERYKQGKSKWFFEKLRF

SEQ ID NO: 515 - protein, 198 aa, Piezodorus guildinii
MAVQNKKKGAAAPEKKKSLKKEPKDKSKNVMKEVRIRKLCLNICVGESGDRLTRAAKVLEQLTGQQPVFSKARYTVRSFGIRRNEKIAVHCTVRGAKAEEILERGLKVREYELRRDNFSDTGNFGFGIQEHIDLGIKYDPSIGIYGLDFYVVLGRPGFNVAHRRRKTGVVGFQHRLTKEDAMKWFQQKYDGIILPGKK

SEQ ID NO: 516 - protein, 1952 aa, Piezodorus guildinii
MASKGPAGMQVGADDPDPTPYLFVSLEQKRIDQTKPYDAKKACWVPDEAEGFLQGEIQGTKGDIVSVKLPGGETKDFKKDLVGQVNPPKFEKCEDMSNLTYLNDASVLYNLKQRYYHKLIYTYSGLFCVAINPYKRFPVYTLRCAKLYRGKRRNEVPPHIFAISDGAYVNMLTNKENQSMLITGESGAGKTENTKKVIAYFATVGASTKKDEASEKKGTLEDQVVQTNPVLEAFGNAKTVRNDNSSRFGKFIRIHFGPSGKLAGADIETYLLEKARVISQQTLERSYHIFYQIMSGAVKGVKAKCLLSDDIYEYNFISQGKVTIAGVDDAEEFQLTDEAFNVLGFTQQEKDDIYKITAAVMHMGCMKFKQRGREEQAEADGVEEGIRVGKLLGIDGEELYKNLLKPRIKVGNEFVTQGRNVHQVTYSVGAMSKGMFDRLFKFLVKKCNETLDTKQKRQHFIGVLDIAGFEIFDYNGFEQLCINFTNEKLQQFFNHHMFVLEQEEYKKEGINWAFIDFGMDLLACIELIEKPMGILSILEEESMFPKATDKTFEDKLNSNHLGKSPNFQKPKPPKPGCQPAHFAIGHYAGVVSYNITGWLEKNKDPLNDTVVDQYKKGSNALLCEIFADHPGQSGAAGADAGGKGGRGKKGGGFATVSSSYKEQLNNLMTTLRSTQPHFVRCIIPNELKQPGVIDSHLVMHQLTCNGVLEGIRICRKGFPNRMAYPDFKLRYKILNPAAVEKLTDEKAMAGVILESTGLDPDMYRLGHTKVFFRAGVLGQMEELRDERLSRIISWMQSYIRGYLCRKEFKKLQEQRLALQIVQRNLRRYLALRTWNWWKMWSKVKPLLNVANVEEEMRKLEELVAQTQAALEKEEKARKEVEALNAKLLAEKTELLRNLEGEKGTLGSLQERSAKLQAQKADLESQLMDTQERLQQEEDARNQLFQQKKKLEQENSSLKKDIEDLELSVTKSDQDKASKEHQIRNLNDEIAHQDELINKLNKEKKIQSEHNQKTAEELQAAEDKINHLTKVKAKLEQTLDELEDSLEREKKLRGDVEKAKRKTEGDLKLTQEAVADLERNKKELEQTIQRKDKEMASLTAKLEDEQGIVNKTGKQIKELQARIEELEEEVEAERQARGKAEKQRADLARELEELGERLEEAGGATSAQIELNKKREAEMSKLRRDLEEANIQHESTLANLRKKHNDAVSEMGDQIDQLNKLKTKVEKEKCQYLCELNDLRASIDHLTNEKAATEKIAKQLQHQLNEVQGKLDEANRSLNDFDAAKKKLSIENSDLLRQLEEAESQVSQLSKIKISLTTQLEDTKRLADEEARERATLLGKFRNLEHDLDNLREQVEEESEAKADIQRQLSKANAEAQLWRHKYESEGVARAEELEEAKRKLQARLAEAEETIESLNQKVIALEKTKQRLATEVEDLQLEVDRANAIANAAEKKAKAIDKIIGEWKLKVDDLAAELDASQKECRNYSTELFRLKGAYEEGQEQLEAVRRENKNLADEVKDLLDQIGEGGRNIHEIEKQRKRLEVEKDELQAALEEAEAALEQEENKVLRAQLELSQVRQEIDRRIQEKEEEFENTRKNHQRALDSMQASLEAEAKGKAEALRMKKKLEADINELEIALDHANKANAEAQKSIKKYQQQLKDVQTALEEEQRARDDAREQLGIAERRANALGNELEESRTLLEQADRGRRQAEQELTDAHEQINELAAQATSASAAKRKLEGELQTLHADLDELLNEAKNSEEKAKKAMVDAARLADELRAEQDHAQTQEKLRKALETQIKELQVRLDEAENNALKGGKKAIAKLEQRVRELENELDGEQRRHADAQKNLRKSERRIKELSFQSDEDRKNHERMQDLVDKLQQKIKTYKRQIEEAEEIAALNLAKFRKAQQELEEAEERADLAEQAVTKLRTKTGGRAGSTARAMSPVNRNPMRP

SEQ ID NO: 517 - protein, 255 aa, Piezodorus guildinii
MSSIGTGYDLSASQFSPDGRVFQVEYAQKAIENSGTVIGLRGKDGVVLAVEKLVTSKLYEPGANKRLFTIDKHIGMAVAGLISDARAVAEVARTEAANYRSQYKSSIPLKYLNERVSMYMHAYTLYSAVRPFGCSVILSTYTEEDGPEMYMIDPSGVSYGYFGCAVGKAKQAAKTEIEKLKLKEMSCQELVKEAARIIYLVHDELKDKQFELEMSWIGSHTNGVSQQVPASVHAEAEKDAKAAMEEDSDSETEDI

SEQ ID NO: 518 - protein, 266 aa, Piezodorus guildinii
MVETSVVTPAAPAANKKAGSTRKPQRRNYNLGSGVYRFSRTRMFHKKALWKFIGKKTPKTPRPKRKTTLEKKIGGEKNGGTRTVYLKKRTKSYPTANKVRKHPSKTYFCQHKRRFRASLKPGSIVILLAGLHKGKRAVLLKNMPSGLLLVSGPYTLNGVPLRRIHPNYVIATSTQIDLSGVKLPEHMNDKYFKRVKAKKAKKSDGEIFAAKKELYKPSEQRKTDQKEVDKQVLQAIKKHEHSLLLRKYLCTMFGLRSSQYPHRMKF

SEQ ID NO: 519 - protein, 243 aa, Piezodorus guildinii
MSTKDKLAIFPSRGAQTLMKGRLVGAQKGHSLLKKKADALQIRFRMILSKIIETKTLMGEVMKEAAFSLAEAKFATGDFNQQVLQNVQKAQIKIRTKKDNVAGVTLPVFESYQDGTDSYELAGLARGGQQLAKLKKNYQKAIKLLVELASLQTSFVTLDEVIKLTNRRVNAIEHVIIPRIERTLQYIISELDELEREEFYRLKKIQDKKRIARQKAEAKKAVDAAAATMASNILEENDEDLLF

SEQ ID NO: 520 - protein, 221 aa, Piezodorus guildinii
MAPKGNNMIPNGHFHKDWQRFIKTWFNQPARKYRRRMKRVKKARALAPRPATLLRPAVRCPTVRYHTKLRPGRGFTLEEIKRVGLCPGFARSIGIAVDHRRRNKSVESLQLNVQRLKEYQAKLILFPSKKSKKVKKGEASAEEQALAAQVSSPVMPIKQTVVKMKARTITPEDKSFSAYAALRKARADERLVGIRAKRLKEAADNPETVEKAAKQKKIKTK

SEQ ID NO: 521 - protein, 205 aa, Piezodorus guildinii
PLWLSIPCLCLQQVIVLLLHVILCNLDMDGLLLEPTLYTVKGMVILDNDGHRILAKYYDPSVFPTSKEQKAFEKNLFNKTHRANAEIIMLDGLTCVYKSNVDLFFYVMGSSHENELILMSVLQCLYDSISQILRKNVEKRTLLENLEIVMLAMDEICDGGIILEADPTSVVQGVALRTDDIPLGEQTVAQVLQSAKEQIKSAILK

SEQ ID NO: 522 - protein, 182 aa, Piezodorus guildinii; identical to SEQ ID NO: 363

SEQ ID NO: 523 - protein, 127 aa, Piezodorus guildinii
MTDEVNPKAYPLADATLTAKILNVVQQALNYKQLRKGANESTKTLNRGLAEFIVMAADAEPLEILLHLPLLCEDKNVPYVFVRSKQALGRACGVSRPVVACSVTLNEGSQLKPQITKIQQDIERLLV

SEQ ID NO: 524 - protein, 433 aa, Piezodorus guildinii; identical to SEQ ID NO: 365

SEQ ID NO: 525 - protein, 147 aa, Piezodorus guildinii
MKMNKLVTSSRRKNRKRHFTAPSHIRRKLMSAPLSKELRQKYNVRTMPVRKDDEVQVVRGHYKGQQVGKVIQVYRKKFVIYIERIQREKANGASVYVGIHPSKTVIVKLKIDKDRKEILDRRSRGRALALGKDKGKYTDENTAMDTS

SEQ ID NO: 526 - protein, 955 aa, Piezodorus guildinii
MAVVEQPCYTLINFPSDLEPPNEMQLKSDLENGDTKAKIEALKNIIHLIANGERLPGLLMHIIRFVLPSQDHTIKKLLLIFWEIVPKTTPDGKLLQEMILVCDAYRKDLQHPNEFVRGSTLRFLCKLKEPELLEPLMPAIRACLEHRVSYVRRNAVLAIFTIYRNFEFLAPDAPELIANFLDGEQDMSCKRNAFLMLLHADQERALSYLASCLDQVNSFGDILQLVIVELIYKVCHANPSERSRFIRCIYNLLNSNSPAVRYEAAGTLITLSNAPTAVKAAASCYIDLIIKESDNNVKLIVLDRLISLKEIPTHERVLQDLVMDILRVLASPDMEVKKKALSLALDLTTSRCVEEMVLMLKKEVAKTHNLTEHEDAGKYRQLLVRTLHSCCMKFPDVAASVIPVLMEFLSDTSELASYDVLIFVREAIHKFDSLRALIIEKLLEAFPTIKSMKVHRAALWILGEYTTSVTDIKEVMKQIKNALGEIPLVDDEIKRASGEKVEEVDHRDQVKLVTSDGTYATQSIFNTILSIKKEDRPPLRQYLIDGDFFIGVSVASTLVKLALRYKELVKQENMYHKFFAECMLIISSIVRLGKSGYPSKQLSYDDYERMLLCLKVLSENNAPIIKIFNTDCRNALANMLVAQQNEEYSLIKAKEKSVHTIQVDDPVSFLQLSTMRSSDFGSENVFELSLNQAVGGPNTAANTTELPFSASKLNKVTQLTGFSDPVYAEAYVHVNQYDIVLDVLIVNQTGDTLQNCTLELATLGDLKLVEKPQPCVLAPYDFCNIKANVKVASTENGIIFGNIVYDISGAASDRNVVVLNDIHIDIMDYIVPATCSDTEFRQMWAEFEWENKVSVNTYLVDLHEYLGHLLKSTNMKCLTPEKALCGQCGFMAANMYARSIFGEDALANLSIEKPFNKPNAPVTGHIRIRAKSQGMALSLGDKINMTQKKPTIMAQ

SEQ ID NO: 527 - protein, 167 aa, Piezodorus guildinii
MPFQRFVETGRIAYIADGPYQGKLCAIVDVINQTRALVDGPETGVPRCGIRLNQLHLTKFRIRFPYTASTRVVRKAWKDSNLDAKWKESVWAKKLEAKKIRANMNDFDRFRLNNARRTRSKITTNAFMLLKKQAKKAKKTEAKPGQKPKDKKPDAKKAPAKKAEKKK

SEQ ID NO: 528 - protein, 1680 aa, Piezodorus guildinii
MSQILPIRFQEHLQLSSVGINPTSVGFNTLTMESDKFICVREKVGETSQVVIIDLNDTANPIRRPISADSAIMNPASKVIALKGKAGTDGTTTQKTLQIFNIEMRSKMKAHTMTDEVVFWKWISLNTLALVTETSVYHWSMEGDSQPVKMFDRHSSLNGCQIINYRTDPKQTWLLLIGISAQHNRVVGAMQLYSVERKCSQPIEGHAASFAQFKMEGNPDVSTLFCFAVRTPTGGKLHIIEVGQPPSGNQPFAKKAVDVFFPVEAQNDFPVAMQVSSKYDVIYLITKYGYIHLYDLETATCIYMNRISIDTIFVTAPHESTGGIIGVNRKGQVLSVSVEEDHIIPYINNILQNPDLALRMAVRNNLAGAEDLFVKKFNMLFQNGQYAEAAKVAANAPKGILRTPQTIQQFQQIPNPQGQTSPLLQYFGILLDQGQLNKYESLELCRPVLAQGRKQLMEKWLKEDKLECSEELGDLVKQTDPTLALSVYLRANVPNKVIQCFAETGQFQKIVLYAKKVGYSPDYIFLLRNVMRVNPDQGVSFAQMLVQDEEPLADINQIVDILMEQNMVQQCTAFLLDALKNNRPSEGPLQTRLLEMNLISAPQVADAILGNQMFTHYDRAHIAQLCEKAGLLQRALEHYTDLYDIKRAVVHTHLLGPDWLVGYFGTLSVEDSLECLKAMLTANIRQNLNICVQIATKYHEQLTTKALIDLFESFKSYEGLFYFLGSIVNFSQDQEVHFKYIQAACKTGQIKEVERICRESNCYNPERVKNFLKEAKLTDQLPLIIVCDRFDFCHDLVLYLYRNNLQKYIEIYVQKVNPSRLPVVIGGLLDVDCSEDIIKNLMMVVRGQFSTEELVAEVEKRNRLKLLLPWLETRVHEGCVEPATHNALAKIYIDSNNNPERFLRENQYYDSCVVGKYCEKRDPHLACVAYERGQCDRELINVCNENSLFKSEARYLVRRKDPELWAEVLNENNPYKRPLIDQVVQTALSETQDPEDISVTVKAFMTADLPNELIELLEKIVLDNSIFSDHRNLQNLLILTAIKADRSRVMEYINRLDNYDAPDIANIAINYQLYEEAFAIFKKFDVNTSAIQVLIENVNNLDRAYEFAERCNEPAVWSQLAKAQLQHGLVKEAIDSFIKADDPSAYVDVVETAHKTESWEDLVRYLQMARKKARESYIESELIYAYARTNRLADLEEFISGPNHADIQKIGDRCFDDKMYEPAKLLYNNVSNFARLAITLVHLKEFQGAVDSARKANSTRTWKEVCFACVDSEEFRLAQMCGLHIVVHADELEDLINYYQDRGYFEELINLLEAALGLERAHMGMFTELAILYSKYKPAKMREHLELFWSRVNIPKVLRAAEQAHLWAELVFLYDKYEEYDNAVSAMMNHPTEAWREGHFKDIITKVANIELYYKAIQFYLDYKPLLLNDMLLVLAPRMDHTRAVNFFAKVNHLQLVKPYLRSVQSLNNKAINEALNNLLIEEEDFQGVRTSIDAFDNFDNIVLAQKLEKHELIEFRRIAAYLYKGNNRWKQSVQLCKKDRLFKDAMEYAAESKNSEVAEELLAWFLEKGNHDCFAACLFQCYDLLHPDVILELAWRHNIMDFAMPYIIQVTREYISKVDKLEESEARRLEERAEQDHKPMMMPEPQLMLTAGPGMIGPGFSPAYPNTFTTGMPYQGYGM

SEQ ID NO: 529 - protein, 156 aa, Piezodorus guildinii; identical to SEQ ID NO: 370

SEQ ID NO: 530 - protein, 193 aa, Piezodorus guildinii; identical to SEQ ID NO: 371

SEQ ID NO: 531 - protein, 277 aa, Piezodorus guildinii
MAGVLATERTLPGFSFENCRRNSLLLQQGFKPPTAQKTGTTIVGIIYRDGVILGADTRATEGSTVADKNCSKIHFLADNIYCCGAGTAADTEMTTMTIMSQLELHRLNTGRPVRVSTAKQLLKQLLFRYQGHIGAALVVGGVDVTGPLLYSIHPHGSSECLPFTTMGSGSLAAMTVLESSWKPDLSEEEGKVIVRNAIAAGIFNDLGSGSNVDICIIRKGSVDYIRPFDVANLKGQKQNNYRFRRGTTGVLSTRIIPLVTESEEIKKTEVESMDTSA

SEQ ID NO: 532 - protein, 252 aa, Piezodorus guildinii
KRARIVTLTRLLYFCLVIMGSERYSFSLTTFSPSGKLVQIEYALAAVAAGAPSIGIRASNGVVLATENKYKSILYEEHTIQKVEMITKHIGMVYSGMGPDYRLLVKRARKMAQQYQLVYGEPIPTAQLVQRVAMVMQEYTQSGGVRPFGVSLLIAGWDGDKPSLFQCDPSGAYFAWKATAMGKNFVTGKTFLEKRYSETLELDDAVHTAILTLKENFEGQMTSDNIEVGVCDAQGFRVLDPTTVKDYLANIP

SEQ ID NO: 533 - protein, 261 aa, Piezodorus guildinii
ATASKAAPAPAAKAAAAKSAAPSSAKPASAKQPAPAPKAAQPKAQAKPAAQQQKPAKPQQQGKAAAPAKAQAKPAAQAKPAAPAAAPKQPAAPAAAAGTQPAAAAPKKAPSGAVKKAATAPKKSQNLQKKSHQGVRKQVLKGKGQKKKKVSLKFIIDCTHPYEDKIMDVANFEKYIQERFKVNGKTNNLGNNVTLERNKMKITVTSDVHFPKRYLKYLTKRYLKKNNLRDWLRVVSSSKDTYELRYFQFNSQDDDDEEDND

SEQ ID NO: 534 - protein, 116 aa, Piezodorus guildinii; identical to SEQ ID NO: 375

SEQ ID NO: 535 - protein, 299 aa, Piezodorus guildinii
MGFVKVVKNKQYYKRFQVKFKRRREGKTDYYARKRLIVQDKNKYNTPKYRLIVRLSNKDITCQVAYSRIEGDKILCAAYSHELPHFGIKVGLTNYAAAYCTGLLLARRLLQKLKLDGLYEGTTEVTGDEYNVENLDEGPGAFRCYLDVGLMKTSAGARVFGALKGAVDGGLNIPHSMKRFPGYDSESKEFNAEVHRKHIFGIHVAEYMRQLSESDEEAYKKQFSVYIKNGIVPDAIEDIYKKAHAAIRENPAPRPRVRSKEPIKKRWNRAKLTLAERKNCIAQKKAAFLKKIQAGDVDA

SEQ ID NO: 536 - protein, 570 aa, Piezodorus guildinii
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPP

SEQ ID NO: 537 - protein, 205 aa, Piezodorus guildinii
MMADDEAKKAKQAEIERKRAEVRKRMEEASRGKKAKKGFMTPDRKKKLRLLLRKKAAEELKKEQERKAAERRRIIEERCGKICDVDNASEEKLKKICSDYHQRIGRLEDEKFDLEYVVKKKDFEIADLNSQVNDLRGKFVKPTLKKVSKYENKFAKLQKKAAEFNFRNQLKVVKKKEFTLEEEDKEKKGGIVDWSKKDEKAKVEA

SEQ ID NO: 538 - DNA, 3635 bp, artificial sequence
  Nezara viridula
aacaaccaatgaaatgctgccaacaaggaagaaatgacgtcagtaaaggaaaatcgatgaacttataaaaggaccgctctgcgctgcgcccaattcagtcgcaaagtttctgtgataaagagttgttcaagtatcattggagattgaagatgcagatcttcgtcaagacacttaccggcaaaacaattacattagaagttgagccttctgacacaatagaaaatgttaaggccaaaattcaagacaaagaaggaattcccccagaccaacagagattaatttttgctggaaagcagcttgaagatggccgcacactttcagattataatattcagaaagaatctacattacatttggtgcttcgtctgagaggaggcatgcagatctttgttaaaactcttactggcaaaacaatcactttagaagttgaaccttctgacacaatcgaaaatgtcaaggctaaaatccaagacaaagaaggaattcccccagaccaacagagattaatttttgctggaaagcagcttgaagatggccgcaccctttcagattataatattcagaaagaatcaaccttacatttagtacttcgtttaagaggaggcatgcagatcttcgtcaagactctaaccggtaaaacaattacattagaagttgagccttcagacacaattgaaaatgttaaggccaaaattcaagataaagaaggaattccaccagaccaacaaagactgatttttgctggcaaacaactagaagatggccgtaccttgtcagattacaatatccagaaggaatctactcttcatctggtcttacgtctgagaggtggaatgcaaatttttgttaaaactttaactggtaaaacaattacattggaagttgagccttctgacacaatcgaaaatgtcaaggctaaaattcaagacaaagaaggaatccctccagaccaacagagattaatatttgctggaaagcagcttgaagatggccgtactctttcagattacaacattcagaaagaatctactttacatttagtacttcgtcttagaggaggaatgcagatttttgttaaaactctgactggcaaaacaatcacactggaagttgaaccttcagatactattgaaaatgtgaaggcaaagatccaagataaggaaggtatccctcctgatcaacagagattgatttttgctggaaagcagcttgaagatggacgtactctttctgattataacattcaaaaagaatctactcttcatttagtcctgcgtttacgtggtggaatgcaaatatttgttaaaactcttaccggcaagacaatcacgctggaagttgaaccatctgacactattgaaaatgtcaaagcgaaaattcaagataaagaaggaataccccctgaccagcagcgtttaatttttgctggaaaacaacttgaagatgggcgaaccctttcagattataatattcaaaaagagtccactcttcatcttgtactgcggctgcgaggtggtatgcaaatatttgtgaagactttaacaggaaagacgattacattggaagtggaaccttctgatacaattgaaaatgttaaagctaaaattcaagataaggagggtattccaccagatcagcaacgtttgatctttgcaggaaaacagttggaagatggtcgtactctgtctgattataacattcagaaggaatcaaccttacatttagttctacgtttacgtggtggaatgcaaatttttgtcaagacactaacaggaaaaaccattacattagaagtggaaccttctgacactattgaaaatgttaaagctaaaattcaggataaagaaggaattccgccagatcagcaaaggctgatctttgcaggaaaacagttggaagatggacgcaccctttctgattacaatattcaaaaagaatccacactgcatcttgtacttcgacttcgtggaggtatgcagatctttgtgaaaactttaactggcaaaactataaccttggaagttgaaccatctgataccatagaaaatgttaaagctaaaattcaggataaagaaggtattccacctgatcagcagagactgattttcgctggtaaacaactagaagatggccgcaccctctctgattataatatccagaaagaatcaaccttacatttagtacttcgtttaagaggaggaatgcagatcttcgtcaagactctaactggtaaaacgattacattagaagttgagccttcagacaccatcgaaaatgttaaggctaaaattcaagataaagaaggaattcctcctgaccagcagcgtttgatcttcgctggaaaacaactcgaagatggccgaaccctgtcagattataatatacaaaaagagtccactcttcatcttgtactgcggctgcgaggtggtatgcaaattttcgttaaaactttaaccggcaagaccatcaccctggaagttgaaccttcagataccattgaaaatgttaaggctaaaattcaggataaagaaggaattccacctgatcaacagagattaatttttgctggtaaacaactagaagatggtcgtaccctctccgattataatatccaaaaagaatccacattacatcttgttcttcgtctgcgaggtggcatgcaaatttttgttaaaactctcactggaaagactatcactttggaagttgagccatctgatactattgagaacgttaaagccaaaattcaggataaagaaggaattccaccggatcaacagagattgatttttgctggaaagcagcttgaagatggccgaaccctttcagattacaatattcaaaaggaatccaccttacatcttgtacttcgtcttagaggaggtatgcaaatttttgttaaaactcttaccggcaagacaatcacgctggaagttgaaccttcagataccattgaaaatgtgaaggctaaaattcaggataaagaaggaattccaccagatcaacaacgtttgatttttgctggaaaacaactcgaagatggccgaaccctttctgattacaacattcagaaggaatctactcttcatttggtcctgcgtttgagaggtggaatgcaaatttttgttaaaactttaactgggaaaacaattacattggaagttgaaccatcagatactattgaaaacgttaaagctaaaattcaggataaggaaggaattcctccagatcagcagagattgatttttgctggcaaacaattagaagatgggcgcaccctctctgattataatatccaaaaggaatcaacattgcatcttgtacttcgtctgagaggaggaatgcaaatttttgttaaaactttaaccggaaaaacaatcacactagaagtagaaccttctgacactattgaaaatgttaaagctaaaattcaggataaagaaggaattccaccggatcagcagagacttatttttgctgggaaacaacttgaagatggccgaaccttgtctgattacaacatccagaaggaatcaaccctgcatttagttttgcgtcttaggggcggatattaaggctattagcatttcattccatcaaaattccatatcagtaaattgcttttgatattttta

SEQ ID NO: 539 - DNA, 514 bp, artificial sequence
  Nezara viridula
tgatcaatctaactgtgccaaacgtccattttcttaccttgtggttctacagcgttttctctaggttagtcctttcgttggacatccagtatcatcgagttaaaggtgtttatttattttcgaaatggcgcctaaggctcctaagtatgaaatggccgttggccttaaaaaaggccacagaactaccaagattgtaatgggaaaatctaaagcagataaaaagcacaaagttaggccatctcgcttgaagggcagacaaactaagcataccaagtttgtgagagatctaattagagaagtttgtggccatgcaccgtatgaaaagagaggaatggaattgctgaagatttccaaggataagagagctttgaagtttttgaagaggaggatcggcactcacatccgtgctaagaggaagagggaagaacttagcaacattcttactcagatgcgtaaggcacatgcccaacaaaaataattgttttactttctaataaagtcttttaaaaatttt

SEQ ID NO: 540 - DNA, 1284 bp, artificial sequence
  Nezara viridula
ctgatatcgaaaagtgggctgggcacttttactgactgtggccatctaaccttcgtcagattacaagttacatactttttactttcaggacagtaaatactaatttaacaaaatgtctcttagcgacgcagatgtacaaaaacaaattaagcatatgatggccttcatagagcaggaggccaatgagaaggcagaagaaattgatcaaaaagctgaagaagaattcaatattgagaagggaaggcttgttcagaatcaaagattgaagataatggaatattatgaaaggaaagaaaaacaggtggaacttcagaaaaaaattcaatcttcaaatatgttgaatcaagcacgtctcaaagctttgaaaatacgtgaagatcatgttcgtgatgtgcttgatgatgccaggaagagactattgcaatcagtcaaagatgaggcacgttacagagatattcttgtgaaacttatgcttcaggggttatatcagttgatggaagcagaaattttggttagaactcgtgaaatggatggcccacttgtcagctcagtgtttcctgatgtgctagtgaaatacaaggaagtttcaggtaaggatttgcagcttaagttggataccgaattatacttaccatctgaatgtgctggtggcattgagctttatactgccagaggccgtataaagattgctaatactctcgaatccaggcttgatcttatatcagcacaattattgccacaaataagaacatctttgttcggtagcaatgtgaaccgtaaattcaatgactaaatatcagtaattcagcttaaaaaaaaagtataataataaggaaattaatcagttctaccattctgtgaggtactagttagtatctacttagttatgtggaatttaaaaatctcattttccattttagtgtttttattttaattgcaaaaaaaaaaaagaaggagaagaggaatatgtaaccctttagtattttgcttattaatttttttctttcacagaatggtgtgaacttggcaattgattccttttcataacacacttacattccatagtattttgtcttaaatactgaaaaatatcaataaaaacaaacccgaaataataaggaaattggtaattaaccattctgggccttccttttatcccataaattttatggatacttaattttatattttaaaataggtgagggttgagaaacatttctgaatttttccctctaaaagtttactgtttatggtgtatataacattgtaaaaaaaaaaaaaaaa

SEQ ID NO: 541 - DNA, 577 bp, artificial sequence
  Nezara viridula
ccttgaacagctgttactacattcgttcctggttagtctgttctggttcttcagttatctaaatattatcgagtttcttccttaataatttaaatggctagtcagactcaaggaattcaacaattattggcggctgagaaaagagctgccgaaaaagttgctgaggcgaaaaaacgcaaagctagacgtctcaagcaagccaaagaagaggcccaagaagaaattgaaagatataagcaagatagagaaaaacagttccgagagtttgaagcccagcatatgggctcacgagaagatgttgcggccaggatagatgctgacacccgccaaaagattgaggaaatgaatgaagcagttaatgctaacaaagaagcggttattcaaagaattttggaattggtttacgatatcagacccgagatgcataagaactacagagcaccaaattaaataaagttatcaggagttcatctatcatgattcccttaaaatttttctgtattaatagctatggtgtgtggaaatttaatatagagtaaacttcttgtaaaattaacaatatattatttttttctga

SEQ ID NO: 542 - DNA, 1591 bp, artificial sequence
  Nezara viridula
atgtctacatctaaaacagaagaaaagcctatgtgggatgaaagaatggttcatgaacccgaagatatcagaaatgagaattccttatatgaaatcgttagtcgtaactaacttcttgacgaaagtaccaagataatgaaaagtgaagttatgcgtgttagtcatgagctgcaggcacaaaccgaaaaaattaaagaaaatacagagaagattaaagtaaacaaaaccttaccatatctggtttcaaatgttattgagttacttgatgtagatccagaagaaactgaggaagatggtgctgtggtagatctagatgcccgtcgtaaagggaaatgtgcagtcattaagacttcaaccagacagacttattttttgccagtaattggtttagtcgatgcagaaaaattaaagccaggtgaccttgttggagtgaataaagattcttatttaatccttgaaactttacctgctgagtatgatgcccgagttaaagcaatggaagttgatgagagaccaacagagcagtattctgatattggtggactagataagcagattcaggagttaattgaagctgtcgttcttcctatgacacacaaagaaaaatttgaaaatttaggaattcatccacctaaaggtgtgctactttatggacctcctggaacaggaaaaactttgttggccagggcatgtgcagctcaaactaaatcaacatttttgaaacttgctgggccccagctagtccagatgttcattggggatggggccaagcttgttagagatgcttttgctcttgctaaagaaaaatctccagctattatatttattgatgagctggatgctattggtacaaaaagatttgattctgaaaaagcgggtgaccgagaagttcaaagaactatgttggaactccttaaccagttagatggatttagttctacagctgacataaaggttattgctgcaacaaatcgagtagatattttagatcctgcccttttgcgttcaggcagacttgacagaaaaattgaatttcctcatcctaatgaagatgctagagctcgtataatgcaaatacattcacgtaaaatgaatattagcgttgatgtcaattttgaagaacttgctcgttcaactgatgatttcaatggagctcagtgcaaagcagtatgcgtggaagcaggtatgatagcattgaggagaggagctggagtagttactcatgaagatttcatggatgcgatattagaagtacaagcaaagaagaaagccaaccttaactattatgcttaattatcttttgaaattgtgcagaaactcacttccattcttgttttggagagtacctgccaataactgttattgccttctattattataaacatgtaaatatgtctttctgttatcaaaccaacattagattttcatctaattcagaaagtcactacaatcaaaaaaaagttttgtcaattctttttttttttttttttttttttaattttagttcaaacagaattaaattttccatatcagttactaattttgtcttgtttgaaatgagtttctgccatatttaatatttaatttgtat

SEQ ID NO: 543 - DNA, 564 bp, artificial sequence
  Nezara viridula
gttggtactggcaccatcctaataactcaccaccatattgaagatcccacgtacagaagtcttttgactactagaggatcttcagaatgcagatcttcgttaagaccctcacgggtaaaaccattaccctagaggtagaaccctctgatactatcgaaaatgtgaaagctaaaattcaagacaaagaaggaatacctccagatcaacagaggcttatttttgctggtaaacaattggaagatggaagaactctctctgattacaatatacaaaaagaatctactcttcacttggttcttcgtcttagaggtggcgtcattgaaccaaccctgaagattcttgctcaaaaatacaattgtgataaaatgatttgccgcaagtgttatgcaagacttcatcccagagcaactaactgccgtaagaagaaatgtggtcataccaacaatatccgccccaagaagaagctgaagtagattatttgcctatttcctatcctggatccaaaaaattttctttattacatataaaaccaagtttaaattgatatgaaataaaaatatataa

SEQ ID NO: 544 - DNA, 1537 bp, artificial sequence
  Nezara viridula
ggcgatcgcatgcgcagtacagtttcgttgttctatggacaccatcatcacttttctgactgtctagaaggctgttcctagggacctaaactaagtttgataccgtttgctgacaatccaactggctcaaaagagtcctctgttagtaataggtttgttccaagaatcaatcttgaactaagtaacgccaaagttcctttaagaagaattaggaacctcctctgtttgttaacctgtgtatattcgaatgagcaagcaaaatgacggcttcgcaagcaatggaaccaaatagagaaaaggctttacaagattatcgtaaaaaattactggagcataaggaagtagaagtccgacttaaagaaatgagagaccagttaaaagatcttaccaaacaatatgataaatctgaaaatgatttgaaagccctccaaagtgttggtcagattgtcggagaagtactaaagcagcttactgaagaaaaatttattgtcaaggccacaaatggcccaagatatgttgttggttgtaggcgacaacttgataagttaaaacttaaatctggaactagggtagcattggacatgacaacattgacaattatgagacacttaccgagggaagttgatccattagtatacaatatgtctcatgaagacccaggagatgtcacatattctgctattggaggtcttgcagaacaaattagggaacttcgtgaggtgatcgagctgccactattgaatcctgaactgtttcaacgtgtggggataactcctcctaaaggatgtctactttatgggcctcctggtactggaaagacattattggcccgagctgtagcaagccaattagatgcaaatttccttaaggtagtatccagtgctattgttgacaagtatattggtgaaagtgctcgtctaatcagggaaatgtttaattatgcaagagatcatcagccttgcataatttttatggatgaaattgatgccatcggaggtcgaagattctcggaaggaacatctgctgatcgtgaaatacaaagaacccttatggaacttctgaatcaaatggatggatttgattcactgggacaggtcaaaatgattatggctactaaccgtcctgacaccctggaccctgctcttctccgtcctggcaggctagacaggaagattgaaattccactgccgaatgaacaggcaaggctagaaattctaaagatccatgctgggcctatttctaaacatggagatattgattatgaggctgtagtgaagttgtctgataatttcaatggagctgatttgagaaatgtttgtactgaggctggtctttttgctattcgagctgaaagagaatatgtaatgcaggaagactttatgaaagctgtgagaaaagtagctgacaacaagaaattggagtcaaaactggattataaaccagtataatcagttaatcatttggtgttaataataattcattaacttaatcttatattttgtatatgcagtactaaattcgaaatacattttttttc

SEQ ID NO: 545 - DNA, 1482 bp, artificial sequence
  Nezara viridula
ataaaaaaaaatttaaggttatggtgtaagaatgtatggattattctgaaaccttcttaaaatcttcattacaaacaaaagaaagatcacattgcttgatgacctagcgtttcatttagtaacatggcgggtgcaatgttgtttgagaggtccgtctcttccagagatagggataatagtcgaattcttccaacttctaatagaaatgtcgacgatgacaacgatgaagaagagatcaagaataaggagcaaggaattttgcagttgggtgagcaatacaagaaagaaggcaaagctaaagagttagcagaacttatcaaggcaagtagaccgttcctaagtcaaattagcaaagctaaagctgcaaaattggtgcgttctttggtagattatttcttagatcttgaagctggaatcggaatagaagttcaactttgtaaagagtgcatagaatgggctaaagatgaacacaggactttcctcaggcagtcactggaagctaggcttattgctctgtattttgacacaggaatgttcacagaagcactccagcttggctcaagtctccttaaagaattgaagaagttagacgataaaaatttgcttgtagaagtacttctattggaatctaaaacttatcatgctttaagcaatctttctaaagccagggctgctctgacatcagccaggacaactgctaattcaatatattgtccacctaaaatgcaagcagcccttgatttacaatctggtatattacacgcagcagatgaacaagatttcaaaaccgcttattcatacttttatgaagcttttgaaggttatgacagtgtcgatagcccgaaagcgttggttgctcttaaatacatgcttttgagtaaaatcatgttaaacacaccagaagatgtgcagcagttagttagcggaaaacttgctctgaaacatgctggtaaagatatcgatgcaatgaaatcggtcgctcaagctagccataagagatcacttgcagatttccagttgacgttaaaaaattataagaaagagctagaagaggatccaattgttcgagctcatttgggcacactttatgacaatatgttagaacagaatttgtgtaggatcattgagccttattccagagttcaggtggattttatttctaaatcaattaaacttcctcttccccaagtcgaaaagaagctttctcaaatgattcttgacaagaagttcaacggtattctcgatcaaggtgacggagttcttattgtgttcgaagatgctattgttgaaaaaacttacgaaatggccctggaagttattaacagtatgggtaaggttgtagacacattatatcaaaaggctaagaagctatcttaagtatcattttacagttctcaaatttcgaaaaggctgaaaattattttttcacatgtacaactaactaatagatatcaggaccttattaaagcttttccattataa

SEQ ID NO: 546 - DNA, 606 bp, artificial sequence
  Nezara viridula
tattggtacaggtaatattagctctttgtaacagcagaaccatcttactaggttaggctgtgttgacagtacagcacgtggattatacgtgaaaggcctgaaaaatgaccaactctaagggttatcgacgaggtacccgtgacttgttttcacggggctacaggaaacatggcgtcattccactttccacatacatgaaagtctacaaagttggagacattgtttcaattaagggaaatggtgctgtgcagaagggtatgccccacaaaagttatcatgggaaaacaggacgagtttacaatgtaactcctagagcgttgggtgtgattgttaacaaaagggttcgtggaaaaatattacctaagaggattaacatccgtattgagcatgtcaaccactccaagtgccgtgaagatttcttgaagcgtgtacgagaaaatgaaaggctcaggaaagaggctaaagaaaagggtattcgagttgaattgaaaagacagcctgcccagccacgacctgctcatttgataactgtcaaggagcctccaataatgctcgctcctataccttatgaatttattgcttaaaaataaatgtgttttttattga

SEQ ID NO: 547 - DNA, 750 bp, artificial sequence
  Nezara viridula
gaaaactgacttggaatttttaaatagacaattgtatatctagttatctatggtctccatgttgttttctttcagtgtggaacttagggattaccatgagttcattgaagttacagaagaggctagctgcctctgttatgagatgcggtaaaaaaaaggtttggttagaccccaatgaaattaatgaaatagccaataccaactcaaggcagaacatccgaaagttaatcaaagatggttttattatcaagaaacctgttgccgtgcattccagagcccgtgtacgtaagaatactgaagccaggaggaaaggtaggcattgtggtttcggtaaaaggaaaggtactgcaaatgcaagaatgccagcgaaggttttgtgggtgaacagaatgagggttcttaggcggttactgaagaaatacagagaagccaaaaaaattgataggcaaatgtaccacgacttatatatgaaagcaaaaggtaatgttttcaaaaacaagcgtgtacttatggaatttattcataagaagaaggccgaaaaagctaggtctaaaatgcttcgtgatcaagctgaagccaggaggcaaaaggttaaagaagcaaagaaacggcgagaagagaggattactttgaagaaacaagaaattttacagtcataccagagggaagatgaagctgcaactactgctaaaaaataaatttgttttttaatgtgatccttcgggaaataaattttttttctaaaatcaa

SEQ ID NO: 548 - DNA, 781 bp, artificial sequence
  Nezara viridula
cctcctatatcgaaggggtcgccattgcaggcagccttggccgagtatcgagaaagctcttcgttcacgttaccgtgtttctagaagccttcatttacaatgggggcttacaagtacatccaggaattgtacagaaaaaagcagtcagatgccatgaggtatctgctgcgaattagggtttggcaataccgacaaatgaccaagatgcaccgtgtcgtgaagccttcaagacctgacaaagctagaagattgggattcaagaataagcaaggtttctgcatcttcaggatccgtatcaagcgtggaggcaggaaacgtcccgttccaaagggtgccacttacggcaagcccaagagccatggagtcaaccagctcaaaccgacaagaagtctgcatgctatggctgaggaaaaagttggtaggaaatgcagcggacttagggtattgaactcctactgggtagcgcaggacgccaggtacaagtactacgaagtcatctgcgtcgacccagctcacaaggctataagaagagatgctaaagctaactggatatgcgacccagtgcacaagcaccgtgagatgcgtggtaagacaagcgctgccagaaagtcacgaggtctgggcaaggggcacagatattcacagacaaagggaggttccaggaaggccgcctgggtgagaaggaacaccctgcagctgcgcaggaagcgataatcttgatcacccttttatacttaatgaattattatattaccttttaaagtatgttaaaaaaaaaaaa

SEQ ID NO: 549 - DNA, 1537 bp, artificial sequence
  Nezara viridula
catcagattaacatcaccaatattttagatccaaattgtataatatttaatacaatagagagccttaaatataaaaaaacaaacaaaaaaatacatagtagtattatggagtaactatcgttggagacgtatctgaaggtccttgtagctaacacccctcgatcgaggagtccattctgaggctggaaaccaacggctccgtacctccttcattcccgtcaattctggtctggtgtacgcattggctcttgccgtaaacttttttttctgtaagctcaattaacccttaaacaaaatgtgtgacgaagaagttgccgctttagttgtagacaatggatccggtatgtgcaaagccggtttcgctggagatgatgcaccccgagcagtattcccatcaattgttggcagaccaaggcaccagggtgtcatggtcggtatgggccaaaaggacagttatgttggagatgaagcccaaagcaaaagaggtatcttaaccttgaaatacccaattgaacacggtattgttactaactgggatgatatggaaaagatttggcatcatactttctacaatgaacttcgagttgccccagaggagcacccagttctcctgactgaagcacctttgaaccctaaagcaaatagggaaaaaatgactcagatcatgtttgaaacattcaacactccagcaatgtacgtcgctattcaggctgtcctgtctctgtatgcatctggacgtacaactggtattgtcctggattcaggagatggtgtttcacacactgtaccaatttatgaaggttatgctctacctcatgccatcctcaggttggatcttgctggacgtgacctcactgattacctcatgaagatcttgactgaaaggggatactccttcacaaccactgctgagagagaaattgttagggacattaaggaaaaattgtgttatgtagctctcgacttcgaacaggagatggctactgctgccagttcaagttctctcgagaaatcttatgaactccctgatggacaagtaatcacaattggaaatgaaaggttccgatgccctgaagctctattccaaccttctttcttgggtatggaagcatgtggtattcatgaaaccacttacaattctatcatgaaatgtgatgtcgatattaggaaagacttatatgccaacaccgttctctctggaggtaccactatgtaccctggtattgctgataggatgcagaaggaaatcactgcccttgctccttctacaatgaaaattaagatcattgctccacctgaaaggaaatactcagtatggattggtggatcaatccttgcctccctttctaccttccagcaaatgtggatttctaagcaggaatatgacgaatctggcccatctattgttcacaggaaatgtttctaaagtggctgtcatcacatgtcatgcctacttttccttcctttgtatgctccttctggagacctgcttattcttttgtattataatgtttattatatttgtttattattttaa

SEQ ID NO: 550 - DNA, 1334 bp, artificial sequence
  Nezara viridula
gtatggggggcggttattcccggtgcggacggacggaggataaagcctgcggccaggcccccaccacgtcactcgctagcaagttgcccagggaagcggtctgtctacaggtgttgaagcaaaccagaagcaagcaagatgtgtgacgacgatgttgctgccctcgtagttgacaatggttccgggatgtgcaaagccggcttcgccggagacgacgccccgagggccgtcttcccctccatcgtcggcaggcccaggcatcagggagtcatggtcggtatgggccaaaaggacagctacgtaggagatgaagcccaaagcaagagaggtatcctgaccctgaagtaccccattgaacacggtatcatcaccaactgggacgacatggaaaagatctggcatcacaccttctacaacgagctgcgagtcgctccagaggaacaccccatcctcctgactgaggctcccctcaaccctaaagccaacagggagaagatgacccagatcatgtttgagaccttcaacaccccagccatgtatgtcgccatccaggctgtactctccctctacgcctccggtcgtaccaccggtattgtacttgactcaggagatggtgtatcccacaccgtacccatctatgaaggttatgctcttccccacgccatcctccgtctggatcttgctggacgtgatttgactgactaccttatgaagatcctcaccgagcgtggttacagcttcacaaccaccgctgaaagggaaatcgtcagggacatcaaggaaaagctgtgctatgtcgccctggactttgagcaggaaatggccaccgccgctgcctccacctccctcgagaagtcctatgaacttcctgatggtcaggtcatcaccatcggtaacgagaggttccgttgcccagaggctctcttccagccttccttcttgggtatggaatcttgcggtatccatgagactgtctacaactccatcatgaagtgcgacgttgacatcaggaaggacttgtacgccaacactgtcctttccggaggtaccaccatgtacccaggtattgctgacaggatgcagaaggaaatcaccgccctcgctccttcaaccatcaagatcaagatcattgctcccccagaaaggaagtactccgtatggatcggtggttccatcttggcttccctgtccaccttccagcagatgtggatctccaagcaggaatacgacgaatccggcccaggcatcgtccaccgcaaatgcttctaaacatcacgctacatatttcttatacttattcgtcttttgtactatgtacaggcgcggacaacaga

SEQ ID NO: 551 - DNA, 1952 bp, artificial sequence
  Nezara viridula
cttccaaatcatcttctaaagtttagttatgtcacatagagtactttaaattttgatgataattgtaaaattgtaagctgaaaagcagatgattttagtttttttaaaaaatacagtaactttatttatatttatatcgatatttattgagctatcaaataagaaattttgaccggtacacgtcagcttacgtattgctgctccaggtttgactgccaactgtctgtgataggtgaaactatgttttgcagctgaagtttatttactggtttaaggactgttctatcgcttttgcaaccatggtgctaatcgcagcagcggtttgcacaaaagctggtaaaaccattgtctcaaggcagtttgtcgaaatgacaaaggcccgcattgaaggactcttagcagcatttccaaaattgatgtcatcgggtaaacaacatacatttgtagaaactgattcagtgcggtatgtgtatcagccccttgagaaactttacatggtgctgattaccactaaggcctcaaatattttagaagatcttgaaacacttagactattctctcgtgtgattccagaatattgccgcaatatggaagaatcagaaattactgaaaatgcatttaatcttatttttgcatttgacgaaattgtggctctaggttacagggaaagtgttaacttagctcagattaggacttatgttgaaatggattcccacgaagagaaagtatacatggctgtaagacagtctcaagaaagagaagctaaaaataaaatgagggaaaaagccaaagaactgcagagacaaaggttggaagccggaaaaaaaggctacaaaactccaagtattgctggtttcggttcgtcatcaacatttacaagccctgttgttgaaactattgatctgcctaaacctacatacactcctgcgaaacccgtcttatcagcgaaagctatgaaacttggtggtaaatctagagacgttgaatcatttgttgatcaactaaaatctgagggagaaaatgtcatttctcaagtagctgcaaataaacctgtagtggcgaagttagcttctacaccaaatattcatatggaagaggtccatctaaagcaggaagaaaagctgatggtttctgttgggaaggatggtggaatacagagctttgagctccacggtcttgtaacattacggataactgatgaaaaatatgcgaagataaaagtatatctcgacaataaagataagagaggaattcagttgcagacgcatccaaatgttgataaagaattattcaaactgaagtcacagatcggtttgaaaaatccatcaaaaccatttcctttagggactgatgtaggtgttctgaaatggcggtaccaatctcaagatgaatctgcacttcctcttaccataaactgttggccatccgaaaatgggcaaggaggatgtgatgtcaatattgagtatgagctcgaacatactcatcttgaattaaatgatgttaccatcaacattccattacctattgggtgttctcctgtagttgctgagtgcgatggtgagtataaacatgagtctcgaaggaacttgctccagtgggtgctaccagtcatagacaggagtaacaaatcgggagcaatggagttttcggcatcttcttcaatgccctcagactttttccctttgacagtatcttttacaagtaaacagccctatgcagatctaaaggctgtcgaagttcttcatgttgatgatgaaactcctgttaagttttcaagtgaaacattgttttatacagaaaggtatgaaattgtataaagaaaaatacaaaatatgggggtcatttgatagctttgaatgaatatgtgtaataattgttacttatagtgtattaattcatttatatatatatatagctttctatgtaaattaaaatataattggtttctttta

SEQ ID NO: 552 - DNA, 1650 bp, artificial sequence
  Nezara viridula
ttcttaattaaaatgctcgtttataaattgaaatataatttgcgcgcatgggtacaaaaaccacacttcttcctgtcttagtcctttccatagcaaatacttgagtggaacatgtcggtaacgtcgtctgacaaaaggaatgaagattgggtcggagagtctaaaaatggaccaagcgacaaagaacactcctatgatggtccaccagggatggaccctgaaggaatcatcgaatccaattgggatgaggtggttgacaattttgatgatatgaaccttaaagaagaactattaagaggtatttatgcgtatggttttgaaaaaccttctgctattcagcaacgggcaattatcccatgtgttaggggacatgatgttattgcccaagctcagtcaggtactggtaaaacagctacattttccatttccatattacaacaaattgacactagtgctagagaatgtcaggctctgattttggccccaactcgtgaattggcccaacagattcagaaagtagttattgctctgggagatttcatgggggccatgtgccatgcatgcattggtggtacaaatgtgagagaagatatgcgcaaactagaaatgggtgttcatgtgttggttggaactccaggacgagttttggatatgataagccgcagggctctaaaaacaaacaccataagaatttttgtgttggatgaagctgatgagatgctttctcgtggtttcaaagatcagattcatgatgtgtttaaaaatttgaatcatgaagtacaggttatattgctttcagctactatgccttcagatgtattggaggtcagtacatgcttcatgagaaatcctattcgtatcttagttaaaaaagaagaacttaccttggaaggtattaaacagtttttcgtttttgttgagagggaagagtggaagttggatactctatgtgatttgtatgaaactctaagtattacccaagctgtaattttctgtaatacaaggcgcaaggttgattggctgactgagagtatgcataatagagacttcactgtttctgctatgcatggggatatggaacaaagagagcgagatattatcatgaggcagttccgtactggttctagtagggttttaattactacagaccttttggctagaggaattgatgtgcaacaagtttcgcttgtcatcaattatgatcttccatctaatagagaaaattacattcacaggattggaagaggtggccgatttggtcgtaaaggtgtggcgattaactttgttacagaagaggacaagcgctctcttaatgatattgaacagttctacaacacccgtatcgaagaaatgcctatgaatgttgccgacctcatttaaattgttactaataaaaacagtgaaaattaaatcaatcacacaacactgaggagacactttttggaaataaagacttaaatttccattctgaagctcaacaaacagtggttttacttataataaacctttcaacttcccctccagttatattattgaaatgtggatattttattttttagaattattcagttaaattaattttctacttggtttatatggagcgaataccgtgtacagtcatttttatttataaataaatttttaatctta

SEQ ID NO: 553 - DNA, 970 bp, artificial sequence
  Nezara viridula
ttttaatactaatgtatgaaaaggaataaatatacagtagccattaacgaggaaaatggacgccctttattcacatggcagttgaacgagcctcgtgaagttctttctttcccgtgttccactatggctcgtggccctaagaagcatctgaagcgtttaaatgctccaaaatcatggatgttggacaaacttggtggtgtttttgccccaagacccagctctggcccacacaaactgagggaatccttgcccttagttatttttcttcgtaatagactcaagtatgcccttaccaatactgaagtgaccaaaattgttatgcaaagactgatcaaaattgatggtaaagtaaggacagaccccaactatcctgctggtttcatggatgtgatcagcatcgagaaaactggtgaattttttcgattaatctatgatgttaaagggcgctacgctattcacaggattactggtgatgaagccaagtataagctttgcaaagttaaaagagtgcaaactggacctaagggtattccttacttagtgacacacgatgccaggactataaggtacccagatccacttgtcaaagttcatgataccattcagctcgatattgctactggcaaaataattgatatcatccgaatggagtcaggcaacctttgcatgattactggaggtcgtaacttgggaagagtaggtactgttgtaaacagagaaagacatcccggatcttttgatattgttcatatcaaggatgctagtggacacacttttgccacacgattgaataacgttttcatcattggaaagggtagcaaagcttatgtttcattgcctaagggtaagggtgtgaaactcagtattgctgaagagagggataagaggcttgcggcaaagggtgcatccagctaaaaagcatgaagttgtaataatatttttaaaaaatataaaagttttgaaaaatgta

SEQ ID NO: 554 - DNA, 2548 bp, artificial sequence
  Nezara viridula
gctgcataacctgcgactcaactcaggaggctttattatttcgtcttgctactcatcgttagtgttggacatttcattgaccttttcttgtgttttgagtcgtttgttaatacttataaatggctgatttgaaaagtaatgaagatttgtctactgcaatcctgaaaaagaaagatcggcccaatagattaattgttgaagatgcagtcaatgatgataattctgttgttgccctttcacaggcaaagatggatgaacttcaattatttcgtggagatactgtgcagcttaaagggaaaagaagaaaggaaactgtttgcatagtattatctgatgatacctgccctgatgaaaaaattaggatgaacagagttgttagaaataatctaagagttcgtttgtcagatattgtttcaattcaagcatgtcctgaagttaagtatggcaaaagaatacacgttttacctatagatgacactgttgagggattgactgggaatctgtttgaagtgtttcttaaaccatattttctggaagcatatcgtcctattcataaagatgacacatttgttgtccgaggtggtatgcgtgctgtagaatttaaagtagttgaaacagatcctgctccttattgtattgtagcacctgatactatcattcattgtgagggtactcatatcaagagagaggaagaagaggaagctttaaatgctgttggatatgatgatattggaggctgtagaaaacaactggctcagattaaagaaatggttgaacttcctttgaggcatcctagcttattcaaagcaattggtgttaaacctcctcgtggaatattactttatggaccacctggcactggtaaaacattaatagcacgtgctgtggccaacgaaacaggagcatttttctttttaatcaatggcccagaaattatgagtaaattagctggtgaatctgaaagtaacctgcgtaaagcatttgaacaagccgaaaaacacgctccttccatcatttttatcgatgaactagatgctattgctccaaaacgagacaagacccatggagaagtagaacgaagaattgtctcacaattgcttactttgatggatgggcttaaacaaaattctcatattattgttatggctgctacaaacaggcctaattcaattgatgctgctcttagacgttttggacgatttgatcgtgaaattgatattggtattccagatactactggacgtttagaagttcttcgaattcacacaaaaaatatgaaactggctgatgatgttaatttagaacagattgcagctgaaactcatggtcatgttggtgcagatttagcatctctttgttcagaagcagctcttcaacagatccgtgaaaaaatggatctaattgatttagaagaagaccaaatcgatgccgaagtactgaattctcttgctgttaccatggataacttcaggtatgctatgggtaaaagtagtcctagtgcccttcgtgaaacagtggttgaagttcctaacattacttgggatgatattggtggtctagataatgttaagaaagagttacaagaattagttcagtatccagttgaacatccagaaaagtttttgaaatttggaatgcaaccttcacgtggtgttctattttatggaccaccaggttgtggtaagactttgttggccaaagctattgcaaatgaatgtcaggcaaactttatttcagttaagggtcctgaattattaactatgtggtttggagaatctgaagctaatgttcgtgatatttttgataaggctagagctgctgcaccatgtgttctgttttttgatgagctggattcaattgctaaatcaagaggtggaagtgttggagatgctggaggtgcagctgatagggttatcaaccaaattcttacagaaatggatggtatgggagccaagaaaaatgtctttataattggggctactaatagaccagacataattgatcctgctattctcagacctggtcgtttagatcagctcatttatataccattaccagatgaaaagtcaagagaagccatcttcagagcgaacttgagaaaatcgcctgttgccaaggatgttgatctacaatatattgccaaagttacatttggttattctggggctgatcttactgaggtatgtcaaagagcatgtaaactcgccatcagacagtcaattgaagctgaaattaaaaaagaaaaaagtagatcagatggagctacacgaatggatatggatgatgaagatcctgtccctgaaataacccgtgaacattttgaagaggcaatgaggtatgctaggcgttcggtaactgataatgatattcgcaaatatgaaatgtttgctcagacattacaacaatcaagaggttttggaactaattttagatttcctgctagctcaaatattcctagtgcgccaggaggtgggggaacagaaactaacaactttcctgatgatggagatgatgacctttataattaaaaaaagtttttactagataa

SEQ ID NO: 555 - DNA, 542 bp, artificial sequence
  Nezara viridula
aaactgtaattgggaagccttggcaacactggtctcaaaccttttctctagagctctgtttatcgcaccacgtaaatcccacattttcaaacatgaccattgaagatgaatctggcccatctggcgactccgtcgatatcaacaccgctttaaaagaagttctgaaaggagttgtgaggaatggagttattgtacatggtctgagggagtcagctaaagctctcgataagcgacaggcactactctgtgttctggccgaaaactgtgacgagcctatgtacaagaaacttgtacaagctctctgttcagaacatcaaataccattagttaaggtcgactccaacaaaaaattaggggaatggtctggtttatgtaaaatcgataagacaggaaacccaaggaaggttgtcgggtgctcatgtgtagttattaaggactggggcgatgatacacctcacctagatgtactcaaagattatatgacagaatccatgtgattgtgttttatataattttttaatatataatgtggttttaaggcg

SEQ ID NO: 556 - DNA, 420 bp, artificial sequence
  Nezara viridula
gggcgcagggatcggaaaaaaaaaaaaataacagtagagaacataatgtctggacgtggcaaaggtggcaaggccaagggaaaggcaaagacccgatcatctagagcaggactccagttccccgtcggtcgtatccatcgtctccttaggaaaggtaactacgccgagagagtgggagcaggagccccggtgtatctcgcagccgttatggagtacctggctgctgaagttctcgagttggccggaaacgctgctcgtgataacaagaagaccaggattatcccccgtcatctacagcttgccataaggaacgacgaggaattgaacaagctgctgtcgggagtcaccatcgctcaaggcggagtacttcccaacatacaggccgttctcctaccgaagaagacagagaagagctcttaa

SEQ ID NO: 557 - DNA, 5013 bp, artificial sequence
  Nezara viridula
cgtcttccgttcctgtccttgttagctgagcttgtcctcggcaactcaggatgtaaagtcccgtttctgctacatcaacttgacttttttttttcaacactcgagatggatttcagagctgtcatcttcatattagtcgctgtcgcagcgcttccaggctacgctcaagaaaatgggaccaacttgcttccacgaacaaaaagaaatcctacaaagcttcgtcattcacgacgttttgccgaaagaatgcccacctcttcctactatgatgactacccacctgctaccagtagccagagtcaggaaaaccataaaccaatcttcaccaactgttcaatgtatcaaccttcagttccagaagagctaacacatactaccaccgttatacaggtgactgcggctgacaaagatccgccagaatctggagggaaagtaacctatacttttgttgcaaccccacaagaaagtcaaaaatttaatattgatcctgaaactggggttattactactagacatagctttgatagagatgagccaaaccgagaaaaagaagtttatttaacagttcgagcgaccgacaatggaaggcctcaacttgatgatgtttgtacattcaaggttattattgaagatattaatgacaaccctccagtatttgataaagttgactaccaagaatctgtacctcaagatttaccacctaaacgtgaagtaatgagaatatctgctactgatgttgatgatggaaacaacagtattgttatgtacagcttagaaccaagatctgctgatatttataacaagacctattttcaaattgacagtaaaacaggtgtgatcacccttgatcgagtgatagatcgtgatcctggatataaatttaaacttagagctacagctacagatcatggtgatatccccaagtcagctgttattaaccttgatattcaagtagtggagtctaataagaaagctccagtcttcatgtctataccagcctcacctattgttcttctggaaaatttcactgatttcacagaaaatattgcaaccttaacagccatgtccaatgatgaaaaagctcctgtttttgaattagtcacgggaagaactgagcaaaccaataaatacagtacgtttcggttagagtccgatgcgaatactgcccacataaggcttgccaggcggatggattatgaatctatagctgaatatacattgaccattcgaattcagaacaaatacaatttggcttcagaaactagtatcaatatacagttagaggatgtcaatgataatattcctgcctttactgaagtggtatctggtgttgtactagaaaatgaacccgctggaactccagtcatgcaagttagggctattgatgctgacagtaccactgctcataaccaggtcacatacgaattggctgataatactgaaaattttgctattgatcgatatactggtaacattactacaaaaaagatgtttgatagagaagaacaagatttttataatgttaaagttatagctacagataattctccttctgctttatacaaaactggagtccctaatgaaggtcaacaggtgtttcgaattgaaatagctgataagaatgatcaccctccaaaatttactgaagcagtatatattgctgaagccatccctgagaatgctaatacaaatgctcgtgttacccaagttaatgctcaagacaatgatactgcttcactcgtacattatagtatattttatggaaatgaaaatgatgcatttgtaattgatgaaacaactggtgaaatccgtgtcaataaaaatttagattatgaaaccaggaccaattatactttgaaagttaaagcatttgatggagcttatgaagacaattgtgaggtgcatataaaaattgaaaacgtcaatgataatcctccagtttttgtttcttaccaaaaaactataactataatggaagaagaattattcccaggatgtattgctcagcttgaagcttatgatccagatattccagacagaagtgcacctcagcatatactttattttgttgtaaaagaagagcaaaggatgtggttaaatatcaacaaaaaaggttgcctttcactgataaagcctttagatagagatcctcctaatggtacagagtcttggcaagttttgattggagccaaagatgaagatggtgggcctactggtgtacagcagaccacagagatcacaattacattaacggacataaatgacaatgccccatatttagagatgccccaaccagttatttggacagaaaatgaacctcctggtgatattgtaaaattaaatgctgaagataatgacgggccagaaaatggtcgaccttttactttcaatattgctccttctgctaccactgaaatccagaccaaatttactatttcaggttcaacattaaaatcacttgtcagatttgaccgtgaagaaaggaaatcttattttgtacccattgctattactgatagtggtaaccctagtttgacaggaacaagtacattacatgtagtcatcggtgatgttaatgacaatccaatgaaaagtggatatagtgaaatttttgtttacaattacaagggagaggctcctgatactgaaatcggtagagtatatgtagaagacccagatgattgggatttacctgataaacgttttgaatgggctggtatggctagtccatacttttatttagatccaaagacagggatgattaccatgtcacaaggaactatagatcagtcatatattcttaactttaccgtttttgaaaataccaccaggtattttagtgcccacagtgtaactgctactgtaaatgttactgtcaaagaaataccagaagaagcagttgataagtcaggttctgttcgtctagttgggattactgctgaagaattcatagaatctgattctaatggtgtcagtaaacgcacaatgttcagaaaatatttagcgaaatttttaaatattactgaagaaaatgttgatgtttttactgttttacactctcctcacaatacaaatacaagtttactggacgttcgattttcagctcatggatctccctattatagtccagaaaagttaaatgcagcagtgagtgtgcataatgctgagttagagaaagagctaggagttgtaattctaatggtgaacattgatgagtgccttgttgaaagacagtactgtgaaggttcatgcatcaattttctgaataaaagccgtgaaccgattgcagtttacactaatacaacaacttttgttggtgtaaaagcagttgtagaccctttttgtaactgtgaagtactttcaaggccagtctgttataatggtggtacacttgttggcaatgacaagtgtgaatgtgaacctggctttgaaggaccacattgtgaaattttaagtgttggattcagtggtaatggatgggctctttaccctcccttagaatcgtgtgccgattcacatctgtctttagaacttcgttccaataaaaaagatgggcttgtgttttatctggggcctactaagccaaatcgactgttgaatgtgcaagattttatctcccttgaagtggtagatggctacccagttcttctattggattttggtactgggactgtaaaacttgatcctaaacaaattagacttgatgatggagagcagcatcgcattgatataatatggtccagaacaactattgaattacaagttgataattgcaagctaccttcatgtttaagtctaaaattaaaagctggtgacaatgaatttttaaatgtaaatggaccattacaagtaggaggttcatttgttgatttcaattaccttgacaaccacatgaactggactcacaagccttcaagagtgggattcagtggctgtgttaaaaattttaccttcaataataaattgtataatcttgggatgcctggatattcaaaaaatgctgacattggttgtaatgctggtgtagcagttgcagtatcttttggaatagatcctagttttataattgcaattattatttgcctagctatattactaatactgttgttggcggttgttgtccatcgtagaaaaactgatgacctgtataaagacactgatgatattagagaaaatatcatcaattacgaagatgaaggtggtggcgaaggagatatgacagcctatgacttaaatgtcttaaggctcatgtataatgatgctatacaggacaaacctctgccagatcatttgaattcaaggccagatgaagttcctgatatatgtggttttctggatggaaaaaaacagtctgttgataatgacccagaaactaatccttttgatgatgttagacattatgcttatgaaggtgatggaaatactacaggttctttgtcatcattagcttcaggaactgatgaaggtgatttgaattttgattatttatctaattttgggccacgtttccggaagcttgctgatatatatgggaaagattctagtgatgacgatgatgatgatgataattatcaaaccactgcatctgaaagctggtgttaaattccctttagtttcaaaatgaattaatgtttgtgaaaaatatatccatttccagtttgttgtttcatatgctaatagtgtacaatataagcacaagatatttctttctgtgtgccatttactgagtcaattttaagacaaactatgtatattgttgtaaacagtgtgctattttgtgtaattagactgatatatatatatttatatacttgattgatgatagcgcttcaataaattactagatgttaaatgtctattacatatgtatattgaatggactatttttatattttatgttttggacattttctttggatgatgattcaggaaaacccctgagaaaagaaaaatatctgtctcatttttttttttaaatttacaaagtaaataaatttaatccccaataataaa

SEQ ID NO: 558 - DNA, 1618 bp, artificial sequence
  Nezara viridula
tggggccgcgccgctgaagaaccgccagagttgaaccggtgacaatcggctctacattccatcggttagtcacgcctttagctctccccttgctcaataactgccaacatgtctgacgaggagtattcggagtccgaagaggagactgtaccagagcccgagcctcaaaagaagactgagcgtagacaatctgaaaagggcgatggtgatccagaatttgtaaaacgccaggaggctaaaacatcagctttggacgaacaactcaaggactacatagcagaatggagaaaacaaagagcgaaagaggaagaggacctgaaacgcctcaaagaaaagcaagccaaaagaaaggttatgagagctgaagaagaaaagagactcgctgaaaagaaaaagcaagaggaagaaaggcgagtcagagaagctgaggaaaagaaacagagagatattgaggaaaagaggcgtagacttgaggaagcagaaaaaaaacgacaggcaatgatggcagctcttaaggatcaaagtaaaagcaagggcccaaacttcacaatcagcaaaaaggaagctggtctgaacttgtcttcagcacaaattgaaaggaacaaaacaaaggaacaattagaagaagaaaaacgtatctcccttagcataaggattaaaccattaaatattgaaaatctaaacattgacagattacgattaaaagctattgaactatgggattgcattgttaaactggaaactgaaaagtatgatcttgaggagaggcaaaaacgtcaagattatgatcttaaggaactgaaggagagacaaaagcagcaacttaggcacaaagcactgaagaaaggtttagacccagaggctttgactggcaaatatccacccaaaattcaggttgcatctaaatatgaacgtagagttgatacaaggtcatatgatgacaagaaaaaactttttgagggcggttgggaaaccttgactgctgaagaattagaaaaaatatggaagtctagatatgaacaatttactaagcgaaaacatgctaaattgcctaaatggtttggtgagagacctggcaaaaagaaggatgctcctgaaagccccgaagaggaagaggtgaaaccaaccgatgatgatgtagaaccagtctatgcagaagaagaagaggcagaggaagaggccgaggaagaggaggaggaagaagaagaggctgaggaagaagaagaggaggaagaagaggaagaagaggaagaagaagaataaaaaattcaggttatttctgtacatttatttctaatgaataacaaaatcattattcattgccgttgaatgggatattttattccaaataccagcacatgaaggattataagccttaatttcacatgaatgtaaaaggaaaaagcatttgatgctcagatctcagaaactgtaataagaattgatgagacattaaattatgtgttcaagtgtgtggattttaaatccatatctacgcacataacacaaacacatatacaaaaggtttttgtttacatttaaaagtataaattacagacacaagtataaatgtcattacccaattcatataataaatatatatctcaacactaaaata

SEQ ID NO: 559 - DNA, 973 bp, artificial sequence
  Nezara viridula
aaggagaagtaagcggacaccagtctcatcgccagctcctctcgaatctgtgcgaccggcgtcaacccagcttcatttaccacctgtgaaaacaaaaaacctccacaatggacgcgatcaagaagaagatgcaagctatgaagcttgagaaggacaacgcaatggatcgcgccctcctgtgcgagcagcaggccagggatgccaacctcagggccgagaaggctgaagaggaggccaggtccttgcagaagaagatccaagccattgagaacgacctggaccagacgcaggagcaactgatgcaggtcttgcagaagcttgaggagaaggacaaggctctccaaaacgctgagagtgaggtcgccgccctcaacagacgtatccaactgttggaggaggacctcgaaagatctgaggaaagattggccacagcaacagctaagttggccgaagcctcccaagcagcagatgagtccgaaaggcagagaaaggttcttgagaaccgcagcttggctgatgaagagcgtatggatgcacttgagaatcagctgaaagaagccagatttctggctgaagaagctgataagaaatatgatgaggtcgctcgtaaattggctatggttgaggctgatttggaaagagcagaagaaagagccgagagtggtgaatctaaaattgttgagcttgaagaagaacttcgcgtagttggtaataacttgaaatcactggaagtgtcagaagaaaaggcaaaccagagagaagaagaatacaagaaccaaattaagacccttacaaacagacttaaggaggctgaagctcgtgctgaatttgctgaacgttccgttcagaaattgcagaaggaggtggacaggctggaggacgaacttgtccacgaaaaggagaagtacaaatacatctgcgacgacctcgaccagaccttctcagaactcgttggttaaatttattttcatgt

SEQ ID NO: 560 - DNA, 881 bp, artificial sequence
  Nezara viridula
aaattctctagttggtctttcgagtcgtgacgtttgtaagtgattgtctaacatggctgttggtaaaaataagggtctttcgaagggaggaaagaagggagttaaaaagaaggtagttgaccctttcacaaggaaagattggtatgatgtcaaggccccttctatgttcaatacccggcaaatcgggaagactcttgttaacagaacccaaggaactaaaattgcttccgaaggactcaaaggtcgagtttttgaagtaagcttagctgatcttcagaacgatactgatgctgaaagatcattcaggaaattccgcctcatcgccgaagatgttcaaggcagaaatgttttgaccaattttcatggtatggatttgaccacagacaaactgaggagcatggtgaaaaagtggcagactctgattgaagccaatgtggatgtacgcacaactgacggctatctattacgagtgttttgcattggttttaccaataaggaccagatgtcccagcgtaaaacttgttatgcccaacataatcaagtcagagccattaggaaaaagatggtcgataacataactaataacattagcaacagcgatttaaggattgtcgtaaacaaactgatcccagattcaatagcaaaagacatagaaaaaatatgtcaaggcatctatcccctccatgatgtctacattaggaaggttaaagtactgaagaaaccaaggttcgagttaagcaaacttctcgaacttcatggagatgggaaaggttctgatgaacctggctcaaaagtttcgaggcctgaggcttatgagcctccagttcaggagtcagtttaacttttattaattgttttgttaataaaagtgtaaaaatgtt

SEQ ID NO: 561 - DNA, 806 bp, artificial sequence
  Nezara viridula
cactttatagtggcggtattagagattcctaatctagttggtcgagaacgcagaaggacgagtagttctttcggttgctggttggtcttgtgaaaatgggaagaagaccagctcggtgttatcgctactgcaaaaacaaaccttacccaaagtcaaggttttgtcgtggtgtgccagatcctaagatcaggatttttgatcttggaaagaaaaaggctcgtgtagatgattttccattgtgtgtacatcttgtttctgatgaatatgaacaactttcatcagaagcccttgaagcaggacgtatctgcgccaacaaatatttagtgaaaaattgtggaaaagatcagttccacatcagaatgagattgcatcctttccatgtcatcaggataaacaaaatgttatcgtgtgctggagctgataggctccagactgggatgaggggagcttttggaaaaccacagggtaccgtagctagggtacacattggtcaacccatcatgagcgtccgttccagtgacaggtataaggctgctgtcattgaagctctcaggagagccaagttcaagtttccaggaaggcagaagatctatgtttccaagaaatggggtttcaccaagtatgaccgagagacatttgaggaactccgagctgatggaaaattagagaatgatgggtgcaatgtgaagtacaggagggatcatggccctttgtccaactggaaaaaagttcaagttgaactggcagctgctagttaatttcattttataattttcaaaagaaaataaattgttttaaattgacaa

SEQ ID NO: 562 - DNA, 1042 bp, artificial sequence
  Nezara viridula
atgagctatatttacgttgttgaaggttgtaaacttcatcatgttcacccattgcgttctgaaagagcttacatacaagaaagtacattaccactttcatcatatcgtgaacgcgaagtgaagaaaaggaatggggcggagtttaaagcatgttttcgtgaaggtacctaccatttccatgctctcagattgttccttaagccattttgtgagtggatagaccacgcggtatttcacgtttctgataaaatgacttgtgctactcctatatcgaagaagaagaagtttgtggcagatggagttttccgagcggagctaaatgagttcctcaccagagaacttgctgaagaaggttactctggtgtagaggtccgtgaaactcctagtaggactgaaattataataatggcaacccgtacgcaaagtgtattaggtgaaaaaggccgaagaataagggagttgacatctgttgtgcagaaacgcttcaacttccaaccacagtctttagatctttatgccgaaaaagttccaactagaggtttatgtgctattgctcaagctgagtccttgaggtacaaattgattggaggcttagcagtccgtcgagcttgctacggagtactaagattcataatggaaaacggagccaagggctgtgaagttgtcgtttcaggtaaacttagaggccaaagagcaaaatcaatgaagtttgttgatggccttatgattcacagtggtgacccatgtaacgaatacgttaattcagcaacccgtcatgttttattaagacaaggagtgttaggaattaaggtgaaaattatgcttccctgggaccctacagggaagaatggacctaagaatcctctacctgataatgtatgcgtagtaaatccaaaagatgaagttattccttctgatataaagaccatgggaatagaactacatccaccagccattatttaaattgggttttgcaatggaacaatttttttacctccttcattgttacatcgtaaaacaaatacatttttaaaaaacttaa

SEQ ID NO: 563 - DNA, 499 bp, artificial sequence
  Nezara viridula
gggactcgttctaccttcttgttccaattcgtccagttacgaatagtgtgcttgttctcacttgagctaaggccgttggcgacttgcacgttttttttaaatattaactaaaatgtctaaggctgaacttgcatgcgtgtacagcgcactaatcctcgctgatgacgatgttgccgtaactggggagaaaatccaaaccatccttaaggctgccggcgttgacattgaaccctactggcctggcctctttgccaaagccctcgaaggtgtcaatgtcaaggacctcatcaccaacatcagcagtggtgtaggtgttggcggtggcgcaccagcaggagcacccgcaggtggtgctgctcccgcggctgctgctgccccagccggtggtgacaagaagaaagaagagaagaagaaggaagagagtgaacccgaatcagatgatgatatgggcttcggtctgttcgactaaaaatgtacaaattcctttttttttatatgt

SEQ ID NO: 564 - DNA, 912 bp, artificial sequence
  Nezara viridula
atgctactgtcatagtttcattggtggtatcgtggattagtcattttacttcttatccatggttttgttatcattgagtatttagttaaactaatattgaaagtgcagtccatagacattaaaaatgagtttccttagtaaagttttcctaggcaaaaaagaagaaaaagcacccacagcttcggaagctatacaaaagcttcgcgaaactgaagatatgttaattaaaaagcaagattttttggaaaagaaaatcgaatcggaattaatcctcgtgaagaaaaatggtacaaataatagaagagttgcaattcaagcacttaaaagaaagaagaggtatgagaaacagttacaacaaattgatggtaccttggctacaatcgaaatgcaaagagaagctttagaaggtgctaatactaatacagccgtacttcagacaatgaaatttgctgctgatgcattaaaaactgcccataaacacatggatgtggaccaagttcatgatatgatggatgaaatcgctgagcaacaagatgtcgctaaagaaatatcggaagctatttctaaccctgttgcttttggaaatgacattgatgaggaggaacttgaaaaggagctagaagaattagaacaagaagagctagacagagaacttcttgggacaggtccaactgccgatcaattacctgatgttcctgctactcagcttcctacaaaaccaaagccaattgcatcggaagatgatgaagaattaagacaattacagcagtgggcaacatgagtgaaacatcagtattaatatattaaatcatattgttgaaatttattatgtgtaactacttatcttttttttttttattttggctttgtaacatttttaaataaactcgttaaataagttgtattttgcga

SEQ ID NO: 565 - DNA, 583 bp, artificial sequence
  Nezara viridula
tggcaacattgtttctactgaagccttcttcagtactcttggcttctcacgtttcggtcgtgtggattgttttcttcaattattaatcatgggtcgtatgcacgctcctggtaagggtatatcccaatcagctttaccttatcgaagaagtgtcccaacttggctgaaactatcaccagaagatgttaaagaacaaatttacaaactaggaaaaaagggcctcaccccatcacaaataggtgtcattctcagagattcacatggtgttgcccaagtacgctttgtgactggaaacaagattcttcgtatcatgaaggctatgggattagctcctgatcttcccgaagacctctattttctgattaagaaagctgttgctatcaggaagcaccttgaaaggaacaggaaagacaaagactccaagttccgtcttatcttggtcgagtccagaatccacaggcttgctcgatactataaaaccaaaggtggacttccaccaaactggaaatatgagtccagcactgcatctgctcttgttgcttaattttatattttcacaaataaatggttttgtaaaatctta

SEQ ID NO: 566 - DNA, 1431 bp, artificial sequence
  Nezara viridula
tgtaatctagtgctcctccatttacttcggaggtagggtacagtgaatttaggtgttccctatagtaatttaattctgactgtccgtaacattaaatcatgattcccccgtcttctcggccacaggtcactgtgtacagtgacaaaaatgaaccaactggtgaattattgactctacctgcagtctttaatgctccaattagaccagatgttgtcaattttgtacatcagaatatagctaaaaatcatagacaaccttatgctgtcagtgctgaagcaggtcatcagacttcagctgaatcatggggaacagggcgagctgtggctcgtataccccgtgtaaggggtggtggtacccatcgttctggtcagggtgcctttggtaatatgtgtagaggtggacgtatgtttgctcccaccagagtatggcgcagatggcatcgtaaggtgaatgttaatcaaaagaggtatgcaatggtttctgccattgcagctaccggagttccagctctcgtgatgtctaaaggacacatggtaaatgaagtaccagaaattccacttgtggtgactgataagattcaggagtataccaaaaccaagcaggccacaattttcttacatcgtatcaaggcttggtctgatattcagaaggtttacaaatctaaaagatttcgtgctggtaaaggtaaaatgcgtaataggagacgcattcagcgtagaggacctctcatcatttatgggcaagatcaaggcctaactcgtgctttccgtaacattcctggtgttgatcttatcaatgtttcacgattaaacttgctcaagttggcacctggtggtcatgtgggtaggtttgtgatctggacccaatcagcttttgatcaacttaatgctctctatggtacatggaagaaaaaatccactttaaaaaaggattacaacctgcccatgcccaagatggtaaatactgatttgtctcgacttttcaagtctgaagaaatcaagagtgtccttaaagctccaaggaagaccattgtcaggagggttaggaaactgaacccattgaggaatactcgagcaatgctgaagctcaacccatttgctgctgttctgaagaggaaggctgtccttgctgacaggaaacttaagcttgagagggctattgagagatcaaagaaggaaggaattgagcttacccctcatcagaagaggtatgttgctatgctcgagcgaaggaaagctcagatcaaagctgccaaggctgctaagcccaagaaggtgaagaagcctaaggctgataaacctgctgctactgaagcaaagaaagctactgtgactaaaaagccagcaaaaaaagcaacaacagctgttgctcccaaacctaccaagaaatgagttaaatgttaataaagttggttgagtttggtttttaaaa

SEQ ID NO: 567 - DNA, 739 bp, artificial sequence
  Nezara viridula
agaatgttaaatcaatctcaaaatcgtaaaggcgttggctctagaagctccagtgcagtgcttttaggaacccttccattttaagtgaaatgacggggttttcggacaagcccatcttaattgatggtaaaggccaccttttgggccgactttcagctattgtagcaaaagctgctttgaatggcaacagggtagttgttgtaaggactgagcaaataaatatttcaggaaacttcttcaggagtaaactgaagtacttatcatttttaagaaaaagatgtaatgttaatcctgccaggggtccatttcacttccgagcacccagcaaaattttatacagaaccatcaggggtatggtgccacataaaattgaaaggggaaaggctgctttaaggcgtatcaagttgttcgagggtatccctcccccgtatgacaagaggaaacgagtagtagttcctactgccatgagagtgttgtgcctaaaacctggtagagcttactgccatctaggtaggttgtcttctgaagttggatggaagtacaaggatgttgtgagggcccttgaaaccaagaggaaggtcagggcagtttttgatatccgcaagaggaattctctaaagaaactgactaaacaagccaaggaaaagatgtccaaagcaaatgctaattatactgcagttattaattcttatggatatcgttaagtgtgatatgtgaataaatttttacttatacagga

SEQ ID NO: 568 - DNA, 5435 bp, artificial sequence
  Nezara viridula
gctcggtggagagaacatctgtgacttagcggctatcataccaccgtacaccaggccagtaccagtgccgtgttcgggatagtgttgttgttccagttgttgttgtggtgttgccagctgtgttagcctgtgaccagtgtgttgacgaggctccaagtgtgtttcctagtcaggccagctcggcccgtggggggcccgacgagaatgggccccacttcgaggccggcatgtcccctcccgggcatctacaaggggtggtcgggtgtgaggtcggcgacccactcacatggaataagatgagtggagcagccagtggatcatccaccaagaaaagaaagaaacctgaaaacaaacctcagtctcagattaacaagtgccttaatgaaaagcgaagacgggagcaggagaacatctacatcgaggagcttgctgagcttatctccgcctccttcacagacatgagcagcctctctgtcaaaccggacaagtgtgccatcctacaggagacagttcttcaatttgctgccttacagatcaagactataaagggcggagcagcgactagcgatgccgtccagcaaggagaagtctcatccagcaagccgacaattttaactaatgaggttttcgggccgctcttactcgaggctttagagggcttcctgtttgttgtgaatcctgaaggaaaggtcgagttttgtactgagaatataactcagttcatcaaatatcgccgtgaagaggttctgggacaaccagtgtataacattatccatcacggagaccacgctaggttctcatcttggctgttacctatgagttggtcaaatgattaccatccccctaggcctaggacgtttaactgcaggtttctcatcaaaccacccccagacactactgtagaagagaagcagcagagaccctatctgtatgagaacatgcagatatcctcaacacagcttcctcaaagcagtggagttgataaagatgatgatggtagcagtgaatctggaccatgtttgatgtgtgttgctagaagaatccctgcttgtgaaaagcctgctggctctcctattgagcagtttactatgaaattaaatacttcgggagggattatcaatgtagataatactggtgtttcagctccttattcccaatatttcagcaaggatcatctcaagaataggaatttagatgaacttgtgcagagtagtgatgtgcccaaagtagtagctcatattaaagaagcgctgtccacaggacaaagttcctcatccatttacaaactgcaaattggccatgaaaaatttgttcatgtacaaacgaaattcaagctgttcaaatctgcgaatcgccagatggaaaatgacttcttaatggctactcattcaatattcggggataacgaagtcaatatggaaattggatcccctgcgggaagcaatagtcagtccggtagtggaaacaatagtaaccagcagcagcagcatcaacagcaacagcaacagcaaagttcttcaacaagtggagtcggcggtcccctaattgctagtgtcaatggtgctaataacagagacctaagtaacaccatcacccttaacaacagctccgcttttcattccgtcactctgaactcaaatgaccttgattttaactttgacatcttccccagttcttcgacctgggaccttagcagtgacgaaagggtctgggaaagaccggaatcgcgtcagagtttgactccagtagaaagcccattatattcaaatcctcccgctcaatccccagccactacaccattttccaccccatatgctttttcacccatccaggagacaactcaggaagagcctccggaggaagattctggaaaacttcgaaaaattttgatgacaaagagaccatctacggaatcagatgatggcggtggagggattattgctcaacgtaatagacatcaaatattaaaaattctacttaaccaagaggatgaagaatcacagccccaggactcaaaaccacctaataatatgctactcaagcttttgaacacccaaagtgatgacgatgatgttgaagcaagagctgggttgaagaaacaaaatgagctactccatcagctgctaaaggaagaggataacaaccgcgaaaaccagcaaagcggtgatgatatcctgaaaagtttgggattcagaggagaagggggtgatgaaaatagagggggtaggaagcgcccatcgtcagatgaatgcgaagaccaacctggctcaaaaagatcctcttcttcactgctggatgctgttcctcctcccccaaattcctcaaccccttcggcagcatcgggtaaatcaaggctttgggaaaagaaccagatgcttgcgtctcttttagcaaagcgtccgactactccagcttcaatcccaccaatacctgcttctgtgatttcggccacaccacaggataaactgcagcgtcttgttaaacatccccaaaccagaaaataccgttataattcgggctatgcttgtgatacagtaactatcactgtttcaacaggctggtctgggggtagtgtccaaaccggcgctggctcaccaggacaaagtagatcaggtaggagtccaggttatactggagcaaatacttgggattctgcttcttcagatcctgtcctttccgacatcctggatcaagtaatagagatagtacccgatgttaatacagatgcaccagtgctgatgaatatgatcaactctatggaaactgagacccagcacccgcaatcagctcaacaacaattcgcatctcagcatgaatttttgaatgaaaagatggcaataaatgctattcaaaagtctctgatgctctgtgaatctgctgttaaaagccctacctattcaaatactatgtctcaggggtcacctcagccacagccacagcctcagccccaaccccaaccccagcctcagccccagcctcagcctcagcctcagcaaccatttcatcctcctccaatgtatcaacagaggcaaaggtatccccttcaacaacaacagcagcagcagcaacaacaacaacaacaacaacaacagcagcagcagcaacaacagatcagacaaccattcaacatctctccgatgattctagctcagcggaataagcttcatcaccagcagcaaatgcagcagaagcaaagactgctccagttgcagcaacaacaacagcttgtgattccgtctaatgctacagcgccaaatgctgatcccgccctccataatattgatagccttatcaataatacagttgctccaaatgtatccctccaggtaagatcaagtagtgttcctgattcacaactgtctcctgttggtagttacccaggtctgggatctgttccatcaccaggacagagaagggcttactcacctgtaaacggcgggatgacaagtttctcaagcgcaggtggcacaggcccgcctgtgtcagggagtggacctcaggctaggctctcccccagttctctgcaaggctaccagcaacagccacaactatctccaagactccctcagggccagcaaagctacggtggcggtagtgccacttggtctcagcagaattctcgcctttccctccaacaacaggaaaatcctgtccttaatgctcagttaacgagcggtggacgaggatatgccagagctaattcagcaggtttaccttctgtgagatcacttgcaggtcagcagcgattccctaccgcagctgatcagcagagcggtgctgcttcataccaatttaggctgcagcgccaggtatcagcacctccacctcagcaatcttcacccaacccacagttaccaggtggcacaagggtgggttacggaggcggcttaggttcgccaccactctgccaccacccgccgggagcgtatcatccagaccagcagtactgttaccaaccagaccaagcatatccccctcgtttactactccactcccacggtggtaataatggcgtcacagagtacgtaaggcaagaactgcgtgcaatggttggcgcccgaaccagcggaagcgggcggcctcaagtcccaggctcacttcctctccctacacctgcggttgacctcgattctctaccatatgatatgcaacctcagggagtaaatgacagtccaaagatgtggggtggaatgaatgaaatgggcactagttcacctcaaccaactcaacaactttcctccaggagtaccatggaagaagtgtcgagatcgaatgaccagaaatcatcattgttacaaaaacttttgtctgagtaatgtaaaacacctcacaaattaagtgcattattatatttaatttcattaggaaattttatgaaacaaaagtaaatatgtacataaattattataaataatagttataaatataattttaaaaattactttataaatatatatataaagaggtttagagtaaatatatatattaatatatatatttttgaatgcgggttaccaagccactaatattattgggctcaatgtttgaactataattttattttttctaatttttattttggttgatttatatgaaatctttcttgctgttcatatagttgttaaaagatatatacaagagtatatagcctctattgctttattatcgttggatgtatttctctctttggctttgacaaaaaaggatccaggaggttattgtttgcaaaatattatttcattaaatgaaaagggctttcacttttttgttagtctatagactatagaactcgtctagctgaaatctcacttttttggattctctaacgaaaacaaagcctcctttgcctcttttatgccattttacatataagtaatgatatatgattaaaatgtttgataaaattttggatgtaatttttgaaaaattttgtacagtacaattattagcaccaatatttgtccttgtatagttgattgaatgtatcttattagaaagtggatatataagaaaaaatgttaagacaaaaatgactggtcaacaggaacctcaaaatgctcaataagaaatgtagatttatttattaatgaactcgtcccatatcttttgcctgtcaatcttctctccttattgttatgctatctaatagttatagcactcattgcacaacgctctacctagagggataatgcttcaaatacgctagagttctcttgtaatgagcatttgcctacaatgttcctaaccattttatcccttaatgtttcaaaagcttatagattacttgatattttagaataacgagagatatgttttgtgaattttgatgaagaccagatgtgctagaaaaaagtaatggcaatgtgaatttaaaaaaaaaaataaaaaacaaaaaaatataataagaaaaggtatatgtatgtatatttaaatac

SEQ ID NO: 569 - DNA, 545 bp, artificial sequence
  Nezara viridula
cagtggcaacaacaacgtgggtttctttgaggttcctcacgattcgtcggtgcgtcggattaacattttcatccgaattcatcaatccaaaatggggaagattatgaaagctggtaaggtggtgttggtgctgagtggtagatatgctggaagaaaagccatagtgctgaaaacttgtgatgaaggaacacaagagaaggcatatgggcatgcaattgttgctggcattgatcgttatccccgtaaagtccataagaggatgagtaaaacaaagatccataagaggtctaagatcaagccttttttgaaggttatgaattacaaccaccttatgcccactcgttacacagtatccgagatcgctcctgaccaaaaggtggttacaaaagatttgaaggatccaatgaagaagaagaaaatccgtttccaagtcagggttaagtttgaagaaaggtacaagcaaggcaaaagcaagtggtttttcgaaaaattaaggttttaattgcttgttttttatttcttaataatatataaattttaaaaac

SEQ ID NO: 570 - DNA, 733 bp, artificial sequence
  Nezara viridula
ttttctacttgaataataatttatctctatgttcgtaatgcaatcaagttagcgctggtgcctccgaagttgttctttcgttagttggctacttgaagatatggccgtgcaaaacaagaagaagggtgctgctgcccctgagaagaagaaatccctcaaaaaggaacctaaggacaaatccaaaaatgttatgaaagaagtcagaatccgaaaactctgcttaaatatttgtgttggagaatctggtgacaggcttactagagctgctaaggtgttggaacagttgactgggcagcaacctgtcttttccaaagcaaggtacactgttaggtcttttggaatccgtaggaatgaaaaaattgctgttcactgtacggtccgaggagctaaagcagaagaaattttggagcgaggattaaaggtcagggaatatgaacttcgaagggataatttctctgacacaggcaattttggatttggtattcaggaacacattgacttgggaatcaagtacgatccaagcattggtatctatggtttggacttctatgttgttcttggccggccaggtttcaatgttgctcaccggcgaagaaaaactggtgttgttggtttccaacataggttaacaaaggaagacgcgatgaagtggttccaacagaagtatgatggaatcatcttgcctggcaagaagtaattttgtacttcataataaaccgtttttattaatagg

SEQ ID NO: 571 - DNA, 6197 bp, artificial sequence
  Nezara viridula
aagggctgtcctatatcttttaagcccgctgcagacaggacaaggacagaatggcgtcgaaaggacctgcaggtatgcaaaagggggctgatgaccccgatccaaccccatatctcttcgtatccctggaacagaagagaatcgatcaaacgaaaccatacgatgccaagaaagcttgctgggtccccgatgaagccgagggtttcgtcttgggtgaaatccaaggaactaagggagatatcgtttcagtcaagctcccaagcatggaaacaaaagacttcaagaaagatctggtcggccaagtcaacccacccaagttcgagaaatgcgaggatatgtccaacttgacctacctcaacgacgcttctgtcctgtataaccttaagcagagatactatcataagctaatttacacatactccggtctgttttgcgttgctatcaacccttacaagagattccccgtatacaccatgaggtgcgctaagttgtacagaggtaagaggaggaatgaagtcccacctcacatctttgccatctctgacggtgcctacgtaaacatgttgaccaacaaagaaaaccagtctatgttgattactggtgagtctggtgccggaaagactgaaaacacgaagaaggtaattgcgtacttcgccaccgttggtgccagcacaaagaaagaagaagcttcagagaaaaagggtaccctagaagatcaagtcgtccaaactaaccccgtactagaagccttcggtaatgccaagacagtccgtaacgataactcctctcgtttcggtaagttcattcgtatccacttcggaccatcaggaaaactggccggagctgatattgagacctatctactggagaaggctcgtgtcatctcccaacaaactttggaaagatcttaccacattttctaccagattatgtctggtgccgtcaagggagttaaggagttatgtctgctgtccaacgatatttatgaatacaactacgtcagccagggaaaaattactattgctggaattgatgacggagaggaaatgcagttgacagatgaagccttcaacgtcttgggtttcacccagcaagaaaaggatgacatctacaagatcactgctgctgttatgcacatgggttgcatgaagttcaagcagaggggtcgtgaggaacaggctgaagctgatggcttggaagaaggtatcagggtcggtaaacttctgggtatcgaaggtgaagaactttacaagaacttgctgaagcccaggatcaaggtcggtaacgaattcgtcacccagggtaggaatgtatctcaggtcacatactcagttggtgccatgtccaagggtatgtttgatcgtctcttcaaattcttggtcaaaaaatgtaacgagaccctggacacaaaacagaagaggcagcacttcatcggtgtactggatattgccggttttgaaattttcgactacaacggcttcgagcagctctgcatcaacttcactaatgagaagttgcaacagttcttcaatcaccacatgttcgtcctggaacaggaggaatacaagaaggaaggtatcaactgggccttcattgatttcggcatggacttgcttgcctgtatcgaactgatcgagaagcctatgggtatcctctcaatccttgaggaagagtctatgttccccaaagccaccgataagacctttgaggacaaactgaacaccaaccatctcggcaagtctcccaacttccagaagcccaaaccaccaaaaccaggttgccaggccgctcacttcgccatcggtcactacgctggtgttgtatcctacaacatcaccggatggctggagaagaacaaggatcccctcaatgacactgtcgttgaccagtacaagaagggttccaacaagctcttgtgcgaaatctttgctgatcaccctggacagtcagctcctgctggtgcagatgctggtggcaagggtggccgtggaaagaagggtggtggcttcgccaccgtatcttcctcctacaaggaacaattgaacaacttgatgaccactctgaggagcacacagccccactttgtccgttgtatcattcccaatgaattgaaacagccaggtgtaatcgactctcacctggtcatgcaccaactgacttgtaacggtgtacttgaaggtatccgtatctgtcgtaaaggtttccccaacaggatggcttaccccgacttcaagctccgatacaagatccttaacccagctggcgttgagaaattaaccgacgagaaagccatggctggagtcatcttagaatctacaggtctcgaccccgacatgtacaggcttggccacaccaaggtattcttcagggctggtgtcctgggtcagatggaggaacttcgtgatgaaaggctcagcaggatcatctcctggatgcagtcatacatccgtggttacctctgcaggaaggaattcaagaaactccaagaacagagactcgccctccagatcgtccagaggaacttgagaaggtacctcgctttgagaacatggaactggtggaagatgtggtccaaagtcaagcctctgctcaacgtagccaacgtagaggaagagatgaggaaactggaggagttggtcgctcaaacccaagccgccctcgagaaggaagagaaggcaaggaaagaggttgaggccctcaatgctaagctgctccaggagaagaccgagctcttgaggaacctcgaaggagagaagggcacacttggaagcctccaagagaggtctgccaagctccaggcccagaaggctgacttggagtcccagcttatggacacacaagaaagactccaacaagaagaggacgcaaggaaccaactcttccaacagaagaagaaacttgaacaagaaaatggcagtctcaagaaggacattgaggaccttgagctttccgtcaccaagagcgatcaagacaaggccagcaaagaacaccaaatcagaaacctcaatgatgagattgcccaccaagacgaactcatcaataaacttaacaaagaaaagaagatccagagtgaacacaaccagaagactgccgaggaactccaagccgctgaagacaaaatcaaccacctcaccaaagtcaaagcgaaactcgaacagactttggatgaactcgaagactccctcgaaagagaaaagaaacttcgtggagatgttgagaaggccaagaggaagaccgaaggagaccttaaacttacccaggaagctgttgccgacctcgaaaggaacaagaaggaacttgaacagaccatccagaggaaggacaaggaaatggcttccctcactgccaagcttgaagacgaacaaggaattgtcaacaagactggcaaacagatcaaggaactccaggcccgcattgaagaacttgaggaagaagttgaagctgagagacaagctcgtggcaaggctgagaaacaacgtgccgacctcgcccgcgaacttgaagaactcggcgagaggttggaagaagctggtggtgccacttccgcccaaatcgagctcaacaagaagcgagaagctgagatgagcaaattgaggagggacttggaagaagccaacatccaacacgaaagcacactcgccaatctccgcaagaagcacaacgatgccgtcagcgaaatgggtgaccaaattgaccagctcaacaaactcaagaccaaggttgagaaggaaaaatgccaatacctgtgtgagttgaacgacctccgtgcctccatcgaccacttgaccaacgagaaggctgccactgaaaagattgccaagcagcttcaacaccaactcaacgaagtccaaggaaaactggatgaatccaacaggtctctcaacgactttgatgctgccaagaagaagttgtcaattgagaactcagatctcctcagacaacttgaggaggctgagagccaagtatctcaattgagcaagatcaagatctccctcactacccaattggaagacaccaagaggcttgccgacgaagaggctagggaaagggctacccttctgggcaagttccgcaacttggaacacgacctggacaacctcagagaacaggttgaggaagaatctgaagctaaggcagacatccagaggcaattaagcaaggctaatgctgaggctcaactctggaggcacaagtacgagagcgaaggtgttgccagggctgaagaactcgaagaggccaagaggaaactccaggccaggctcgctgaggctgaggaaactattgaatctcttaaccagaaagtcattgctcttgagaagaccaagcagaggctcgccaccgaagtcgaagatcttcaacttgaggttgaccgcgccaatgctattgccaacgctgccgaaaagaaggctaaggctatcgacaaaatcattggagaatggaaactcaaggttgatgaccttgcagctgaacttgatgccagccaaaaggaatgcagaaattactcgactgagctcttcaggctgaagggagcatatgaggaaggacaagaacaacttgaagctgtccgcagggagaacaagaatcttgctgatgaagtcaaggatctccttgatcaaattggtgaaggtggacgcaacatccatgaaattgagaaacagaggaagaggcttgaagttgaaaaggacgaactccaagctgctctcgaagaagctgaagccgcccttgaacaggaagaaaacaaggttctcagggcccaacttgaactcagccaggtcaggcaagaaatcgatcgtcgcatccaggagaaggaagaagaatttgaaaacaccaggaaaaatcaccaacgtgccctcgactctatgcaagccagtttggaagcagaagccaagggtaaggctgaggctctccgcatgaagaagaaactggaagcagacatcaacgaacttgaaattgctctcgaccatgccaacaaggctaatgctgaagctcagaaatccatcaagaaataccaacaacaacttaaggatgtccagaccgcactcgaggaagaacaaagagctagggatgatgcccgagaacaacttggtattgccgaaaggcgagccaacgctcttggaaatgaactcgaagaatctagaactctcctggaacaggcagaccgcggccgtcgccaggcagaacaagaacttaccgatgctcacgaacagatcaacgaactcgcagctcaagccacaagcgcttctgctgccaagcgcaagctcgaaggagagttgcagacactccatgccgacctcgacgaacttctcaacgaagccaagaactcagaagagaaggctaagaaggctatggttgatgctgcgaggttagcagatgaactcagagccgaacaagaccatgcccaaacccaggagaaactccgaaaggccctcgagacacaaatcaaagaactccaagtcagactggacgaagctgaaaacaatgctctcaagggaggcaagaaagccattgccaagttggaacagagagtcagggaactcgaaaacgagcttgacggagaacagaggagacacgccgacgcccagaagaaccttcgtaaatctgagcgtaggattaaggagctcagcttccaatctgatgaagataggaagaaccacgaacgtatgcaggaccttgtagacaaactccaacagaagatcaagacttataagaggcagattgaagaagccgaagaaattgctgccttgaacctcgccaaattccgcaaagcccaacaggaacttgaagaagctgaggagagagcagaccttgccgaacaggctgttactaagctgagaacgaaaactggcggccgagctggatcaactgcaagagccatgagcccagtgaatcgcaacccgatgaggcccctgctggatggctcagcttttccaccacgatttgacctacaccaggatgacttttaaatattatatatgatagctacgcaaaacaaacccaaacacaattatgtatttattttgaaatatgtaatttaagaatattgttaataattccatagctagtgtccgctagcatcgaagtaatattcacgattagcgaactgtaccttatttcaagaaaatgaaaaaaaaaaagtttttatgtacagtaagaacattcaaaaacactaagtaataaaatatttatatcgtgaataa

SEQ ID NO: 572 - DNA, 962 bp, artificial sequence
  Nezara viridula
gcttgtgagtagacggttttggggaggttctaaacccatgaatttgtgcttttgaagaacagtttgtttcagaacggttatttgaaaatttacaatgagttcaataggaactgggtatgacttgtcagcgtcacagttttctccagatggaagagtttttcaagttgaatatgctcagaaagctattgaaaatagtggaactgtcattggtctgcgaggtaaagatggtgttgttttagctgttgagaaattagtcacatcaaaattatatgaaccgggtgccaataaaagactctttactattgacaaacacattggaatggctgtcgctggactgatttcagacgcaagggctgttgcagaagttgctagaacggaagctgccaattacagatctcaatataagagcagtattcctcttaaatacttaaatgaacgagtgtctatgtacatgcatgcatataccctctacagtgctgtaaggccatttgggtgcagcgtgattctcagcacatacacggaagaagatggtccagaaatgtatatgattgacccttcaggagtttcatatgggtattttggctgtgctgttggtaaggcgaagcaagcagcaaaaactgaaatagaaaagttaaaacttaaggaactgtcttgtcaggaacttgtaaaggaagcagcacgaattatttacctcgtccatgatgagttgaaggacaaacagttcgagttggagatgagctggattggatcgcacacaaatggtataagtcagcaagtccctcccaatgtccatgcggaagcagagaaagatgctaaagctgcgatggaagaagactccgattcagaaacggaagatatatgagcaaggaaacattttttaaacaaataaatactattgtgatgagtgttatttcatattttgtaataaacttatggaaaatacatactgtatttttgcttaa

SEQ ID NO: 573 - DNA, 982 bp, artificial sequence
  Nezara viridula
atttatttggaagatgtatcaaccactgtaggttacctttctaggcaacattggccttcaatgtggttgtgttgtagtgtaaagttggacttcgttaaaaactgaaagttgaaatggttgaaacatcagttgttacccctgcagcttctgctgcgggcaataagaaagcagggccaaccaggaagcctcagcggaggaattataaccttggctctggagtttacaggtttagcagaactcgcatgttccataagaaagctttgtggaaatttattggtaagaaaacccctaagaacccccggccaaaagcgaaaactactcttgaaaaaaagattggtggtgaaaagaatggaggtactcgtaccgtctatttaaagaagaggactaaatcttatcctactgccaacaaggtgaggaaacatcctagcaaaacatatttctgtcaacacaagaggaggttccgtgcatctctgaaacctggtgctgttgtgatactgcttgctgggttacataaagggaaaagggcagttcttttgaagaacatggctagtggtcttctccttgtttctggaccatttactctaaatggtgtccctctcaggagaatacatcccaattatgttatagccacatcaacacagattgatttgtctggtgttaaattgcctgagcatatgaatgataggtacttcaagagagtaaaagctaaaaaggcaaagaagagtgatggtgaaatctttgctgccaaaaaagaactatacaaaccatctgaacagaggaagacagaccagaaggaggtagataaacaaattttacaggctattaagaaacatgaacacagtctacttctcaggaagtacctgtgcacaatgtttggccttcgaagcagtcagtatcctcacaggatgaaattttaatttgttttcaatctgttttatatataaatctgaaaactaattatttttatgttagtataagaggt

SEQ ID NO: 574 - DNA, 941 bp, artificial sequence
  Nezara viridula
atatgatagtaatcagctgatagttgtctggcgttcaatctgttgtttttgtcatcgagaaagatttttatcttaaagaatgtctactaaagacaaattggccattttcccttctcgaggtgcccagactttgatgaaaggaagacttgttggtgctcaaaaaggtcacagtttgttaaagaaaaaagcagatgccctacaaattaggtttaggatgatcctcagcaaaataattgagacaaaaactctgatgggagaagtgatgaaagaagcagccttttcattagctgaagcaaagttcgctactggagattttaaccaacaagttttacaaaatgttcagaaagctcaaattaaaataagaacaaagaaggataatgttgcaggtgtgacacttcccgttttcgagagctaccaagacggaacagattcttatgagcttgctggattggctagaggagggcaacagttggcaaaattgaagaagaactatcagaaagcgataaaacttcttgtagagcttgcttcattgcaaacttcttttgttacgctggatgaagttattaagcttaccaataggagggttaatgctattgaacacgttattataccaagaattgaacgcacacttcagtacattatttctgaattggatgaattggaaagagaagaattctatagactaaaaaagatccaagataagaagcgtattgctcgtcaaaaagctgaagctaagaaagcagtggacgcagccgcagcaacgatggccaacaacattcttgaagaaaacgacgaggacctcctgttttagaaatctgggaggaataattttatcactctgcttgttcagcattcctggatttgaaccatttttaaaccttcctataaaaaacccacctgtgaatagttcatgtcctttaaaatcttctgtccaaaacgtt

SEQ ID NO: 575 - DNA, 835 bp, artificial sequence
  Nezara viridula
tcactctgccatctatgtagtctttagcttcgccacattgcttaggacggcgcggttctccgttggatttagtagtttgttccttgaattaaatatcttgtcctaacagagtatttataaacataaacgaaaaaaatggctccgaaaggaaataacatgattcccaatggtcacttccataaagattggcaaaggtttattaaaacctggtttaatcaacctgctcgcaaatatcgccgaagaataaagagggtcaagaaagcaagggccctggctcctaggccagcagctttattgcgtcctgctgtcagatgcccaactgtccggtaccatacaaaattgagagctggcagaggcttcacattggaagaaattaagagggttggtttatgccccgggttcgcaagatctattggtatcgcagttgatcacaggagaagaaacaagtctgtagagtctttgcaattaaatgtacaacgtcttaaagagtatcaagctaaactgatcctattcccaactaagaagagtaagaagttgaagaagggagaggcttcggaggaagaacaggctttagctactcaggtttcttctcctgtaatgccgattaagcagactgttatcaagatgaaagccaggaccatcactcctgaggacaaaaacttctctgcctatggagctttgagaaaggcaagggcagatgtgagacttgttggaatcagagctaaaaggctgaaggaagcagctgataatcctgaaactgttgagaaggctgcaaaaacgaaaaaagttaaagcaaaataaatattgtaaataaatttttttgatttattctttt

SEQ ID NO: 576 - DNA, 656 bp, artificial sequence
  Nezara viridula
atttgttacctctgtgttcagcgataatttgtttatgtttgcagcaggttacaatacttcttctacacgtcattttttgaagtttagaaatggatgggttattattagaacctactctctatactgttaaggggatggtaattttggacaatgatggacacagaatattagcaaaatattatgatccaagtgtatttccaacttcaaaggaacaaaaaggatttgaaaaaaatttgttcaacaagacccatcgagcgaatgcagaaataattatgttggatggtcttacatgtgtctataaatcaaatgttgatttatttttttatgttatgggaagttcacatgaaaacgagttaatattaatgagtgtactgcagtgcctttatgattccataagccaaatattgaggaaaaatgtagaaaagcgaacactgttggaaaatttagaaatcgtaatgttagcaatggatgaaatttgtgatggaggaataatattagaggcagatccaactagcgtcgtacaaggagtagctttaaggacagatgacatcccacttggtgaacaaactgttgcccaggttctccagagtgcaaaagagcaaattaaatctgcaatattgaagtgaatttaacttaaaatgttttatgggaatttt

SEQ ID NO: 577 - DNA, 1176 bp, artificial sequence
  Nezara viridula
agctctttacgtggcaagaaccacgaaccttttcccctacacaccgtccgccatcttagtcttcacatatattgggacgtgttgatctattacattatttagtgttgaataagtttatctcagttgtataaagtgtcacacaaatccttccaggatggggaatatgtttgcaaatttgttcaaaggcctgtttggcaaaaaagaaatgagaatattgatggttggtcttgatgcagctggaaaaactactattttatataaattaaaattaggagaaatcgtaaccacaatcccaactattggatttaatgttgaaactgttgaatacaaaaatataagtttcacagtatgggatgttggtggtcaagacaaaattcgacccttgtggcggcattattttcaaaatactcaggggctcatttttgttgtagacagtaatgatagagaacgtattggtgaagcgagagaagaactgatgcgaatgctagcagaggatgaattaagagatgcagttctgctcatttttgcaaacaagcaggatctgcccaatgctatgaatgcagctgagataacagacaagctcggcctacactcattgcgcaatcgcaactggtacattcaagcaacatgtgcgacctcaggtgatggtctttatgaaggccttgattggttgtcgaaccaactgaagaatgccaaccgctagcctgcccctcccttccccgacgcgctctcatctcaggggtcctaagtgctctctgcactctagctgccccttatctcatctttatcaccaacacaactcaacattttttagtttatgtatcgctggcgacagtttaaaaaggcagctgattgaagaaatacagtaccaaatgttcatcgtcattattattaatatttaataaataaaaattataatgaatggaaaaaaaattaaatttgtgcgggagtgaaaagtgcgcgcaaggtttaccccaagtctgtctttaattttttttctttttgtcccttgagtttctggtatttggataatgattaaaaaaaaaaacaaaaaaagaaaaaaattatatgtatagacattacattccgtatcctaaaatgtctcccttttaattatattttatatatacgaatgtttttgaaatctttcaaatatattgcgcttgagtgactgta

SEQ ID NO: 578 - DNA, 600 bp, artificial sequence
  Nezara viridula
ttgagcgacgcagtcattcagctccagtttgccggttgttgtttatcgaagctctgtgttcgggctttaaagctagacaaggttttaattccagttcttcctctcaatttttattattaataccttcctccgtgaagtgaattcattcgccgagaggtatttattgctagcaattttcagaatgactgacgaagttaatcccaaagcctacccgttggccgatgctaccctcactgctaagatattgaatgttgtgcagcaagctctcaactacaagcagttaaggaaaggtgccaatgaatctacaaaaactttaaatcgaggattagctgagtttatagtgatggctgcagatgcagaaccacttgaaatcttattgcatttacctctattatgtgaagacaaaaatgtgccatatgtttttgtccgttccaagcaagcccttgggagagcatgtggagtttcacgacctgtcgtcgcttgttcagtgacagtcaacgaaggatctcagctgaagccacagattacaaaaatacaacaagacatagagagactcttagtgtaaataaataatttgtttttgttttttaaatactatat

SEQ ID NO: 579 - DNA, 1362 bp, artificial sequence
  Nezara viridula
atgcctgattatcttggtgatgatatgagaaaaacaaaagatgagatggaaggagaagaaaaggatatcaaatctcttgatgaagctgatatcgctttacttaaaacttatggacagggccaatacacgaaaagtatcaaaagtgtcgaagatgacattcaaaccataatcaagcgtgtcaatgaactgacaggtataaaggagtcagatactggtttagctcctccagctttatgggacttagctgcggacaaacaaatactccaaaatgaacagccacttcaggtcgccagatgtacaaaaattattaatgctgattctgaggacccgaaatacataataaatgtcaagcaatttgcaaaatttgtggttgatttagctgattccgtcgcacctacagatattgaagaaggaatgcgtgtgggcgtcgatagaaacaaatatcaaattcaaatacctcttccacctaaaatagatccaactgtaacaatgatgcaagttgaagaaaaacctgatgtcacttacagtgatgttggtggttgtaatgaacaaattgaaaagttgagagaagttgttgagacgccattattacagcccgaaaagtttgtgaatttaggaattgagccaccaaaaggagttcttctttttgggcctcctggtacaggaaaaacactttgcgcaagagcagttgctaatagaactgatgcctgttttatcagagtcattgggtcagaacttgtccaaaaatatgttggagagggagcaaggatggtgcgtgaactctttgaaatggccagaagtaaaaaggcttgcctcattttctttgatgaaatagatgctatcggtggagccagatttgatgatggagcaggcggcgataacgaggttcaaagaactatgttagaacttattaatcagcttgatggatttgatcccaggggtaacattaaggttttgatggcaacaaatagacctgataccttagaccctgctttgatgaggcctggaaggctggacagaaaggtggagtttggactgcccgatctcgaaggtcgttctcatattttcaagattcatgcacgttcgatgagtgttgagagagatattcgatttgagttacttgctaggctctgtccaaacagtacaggagctgaaatcagatctgtttgtactgaggctggaatgttcgctattcgagctcgaaggaaagttgctacagaaaaagatttccttgaagcagtgaataaagtcattaaatcttatgctaagttctcagctacaccaagatatatgacatataattaaattaagctagctccaggttaactgatttcattaaattatgttactttttttaaaaaa

SEQ ID NO: 580 - DNA, 638 bp, artificial sequence
  Nezara viridula
acactggacataaccttttaccacgctgtcagctttagcttcagctcttctcacgtggtgttcgggtttgtagattgtcgatttattattcgcaatcatgaaaatgaacaagttagtgacctcttcaaggaggaaaaatcgtaaacgtcattttacagcaccatctcacatcagaaggaaattgatgtctgcgcctctctccaaggaactcagacaaaagtataatgttcgtaccatgcctgtcagaaaagatgatgaagttcaagttgttaggggacattacaaaggacaacaggtaggcaaagttattcaggtctacaggaaaaagtttgttatatatatcgaaagaattcaaagagaaaaagctaacggtgcaagtgtgtatgttggcatccatccttccaaaacagtcattgtgaaattaaaaattgataaagataggaaagaaattttggatagaagatcaagaggaagagctctagcccttggaaaggacaaaggaaagtacactgatgagaacacagcaatggatacatcttaaaaaggtgttactttgaattgtgtaaatacattttacataaatttgaaaacattttttctgtgtataccgagaatattttttgtaaaaatcttttttt

SEQ ID NO: 581 - DNA, 3894 bp, artificial sequence
  Nezara viridula
gtaatgcaatactgttttacacgtcttggctatcttagtgttgaaaagagagtagaagattggtttgtgttactcttagcttgttaaatgtcgatgtgaagtaacaaaagtttacttaaactcagctgttttatatccaagtgaaatattaattgatcaaagattaaaatattgaaatataatttgctattcaagaatggctgtggtggaacaaccttgttatactctgatcaattttccatctgatttagagcctcccaatgaaatgcaactaaaatctgatttagaaaatggagacactaaagctaaaattgaagctttgaaaaatattattcatttaattgcaaatggagaacgtctacctggtttacttatgcatattatacgttttgtgttgccatcgcaagaccacaccattaaaaaacttctccttatattttgggaaatcgttcctaagactactctagatggcaaacttcttcaggaaatgattttagtttgtgatgcttaccgaaaggacttgcaacatcctaatgaatttgtcaggggatccacattgcgttttctatgtaaacttaaagaacctgaattgctcgaacctttaatgcctgctataagagcttgcttagagcatcgggtatcatatgttcgaagaaatgctgtacttgctatatttaccatttataggaattttgaattcttagcacctgatgcaccggaacttattgctaatttcttagatggtgagcaagatatgtcatgtaaaagaaatgcgtttttgatgctcctacatgcagaccaagaacgtgccttatcctacttggcttcatgtcttgatcaagtgacttcctttggtgatatacttcaattagttatagttgaattaatatataaggtttgccatgctaacccttctgagcgttcacgatttatacgttgcatttataatttactcaattctaacagccctgcagtacgatatgaagctgctggaactttaattaccctttccaatgctcctactgcaataaaagctgctgcttcatgttatattgacttgataattaaggaaagtgataataatgttaaattaattgtcctagaccgtttaatatctttaaaagagattcctacacatgagcgggttcttcaagatttagttatggatatattacgtgtcttagccagtcccgatatggaagtgaagaaaaaagctttaagcctagcactggatctcactacttcacggtgtgttgaagaaatggttttgatgttaaaaaaagaagttgctaaaactcataacttgacagaacatgaagatgctggaaagtatcgtcaacttcttgttaggactcttcattcctgttgcatgaagtttccagatgttgctgcctcagtaataccagtattaatggaatttctttcagatacaagtgaactagcttcatatgatgttcttatatttgttcgtgaagcaattcataagtttgattctttaagggctttgataatagagaaattattagaagcatttccaaccataaaatctatgaaagttcatcgtgctgctctttggatattgggtgaatatactacttcagttacagatattaaagaagtcatgaaacaaataaaaaatgcccttggagagatgccacttgttgatgatgaaatgaaaagagcttctggagagaaagttgaggaagttgatcatcgtgatcaagtaaagcttgttacatctgatggaacatatgctacacaatcaatatttaataccattcttgctattaaaaaagaagatcgacctcctcttagacaatacttgattgatggagactttttcattggtgtatctgtggcttctactctagtgaaattagccttacgctataaagagcttgttcagcaggagaatatttatcataaattctttgctgagtgtatgcttattatttcatccatagtacgtctgggtaaatctggatatccttcaaaacagctaagctatgatgattatgaacgaatgttactttgtctaaaggttctttctgaaaacaatgcccctattgttaaaatttttaacactgattgtcgcaatgctcttgctaacatgttagttgctcaacagaatgaggagtattcacttataaaggccaaagaaaagtctgtccatactatccaagttgatgatcctgtctcatttttacaattatcaactatgcgatcatctgattttggttcagaaaatgtttttgagcttagtctaaatcaagctgttggaggaccaaatactgctgcaaacacagctgaacttccattttcagctagtaaactgaataaagtaactcagctgactggattttcagacccagtttatgctgaagcatatgttcatgttaaccagtatgacattgtactcgatgttttgattgttaatcaaacaggtgatacgcttcaaaactgtacacttgaactcgcaactcttggtgatctgaaacttgtcgaaaaacctcaaccttgtgttctagctccttatgatttctgcaacattaaagcaaatgtgaaagttgcatctactgaaaatggaatcatatttggcaatattgtttatgatatcagtggtgctgcttctgacagaaacgttgttgtacttaatgatatccatatagatatcatggattatattgttcctgcaacttgttcagatactgaatttcgtcagatgtgggctgaatttgaatgggaaaacaaagtgtctgttaatacttacttggtcgatcttcatgaatatcttggccatttattaaagagtactaatatgaaatgtttaacaccagaaaaagctctctgtgggcaatgtggatttatggctgctaatatgtatgcccgttcaatttttggagaagatgcactggctaacttaagtatcgaaaaaccatttaataagcccaatgcacctgttactgggcatattagaatcagagctaaaagtcagggtatggcattgagcttaggagataaaattaatatgacccagaagaaacctactattatggtgcagtgaagaattataattttattgttaaaatgcattttaacattttatagacttttttatacttatttgcttataagtaattggaactataagtaaaatgtattactcagaatgttttgaaacagatttatttatgttaacaaaatttacttttacttgaatccaatagttgtactgcactatttaatgtgattacatgcaaatatatagattttttgtatatttttatgacttattaaattattgcatttgatgtatattatatattgttgacctaaattaagaaagcttatatatctttctcaagtttttatttttcatgttattttattttgtgatatctcaatttgaaaatgatatatgtctgtatggctatgtgtgtgagtgtgtaaatatacatgggtttattattaatattcaatcaattatatctattattggaaaatggaaaatttatatgtatgtttgtgtgagtgtatatatattcaattgcacatgcatgtttaatatgtgtgtgtgtgtgttttttctttatacaccaactcttaaactcttacatcaactgttttacagttacttctccttctccaaactctctacattcacctcccactcccttaccttttagatcccttccatatgacgcctttccctttctcactgacaacgtacagagcttctttctaacaaatattccttcactaagccttgaactcaagactcaaaataaactctcttacctttttgaaaacactaaagatcttgtttctctccaatactgctctaacattgtttactttattccttgcccctcccctaactgtaatccttcaata

SEQ ID NO: 582 - DNA, 655 bp, artificial sequence
  Nezara viridula
ttggcggaagtgcacacgtgctgcacatttctcaaactaacctttttggttgatctctgggagtaggttgtagagttgggcaaggaaacttattcgactattttccgaaatgccatttcaacggtttgtggaaacgggaagaattgcatacattgctgatggtccataccaaggcaaattatgtgctattgtggatgtaattaatcagaccagggctttagttgatggtcctgaatctggagtaccaagatgtggtataaggttaaatcaattacatcttaccaaattcaggattcgtttcccattcactgcttccacgcgtgttgtacgaaaagcttggaaagatagcaatttggatgctaagtggaaagagagtgtttgggccaagaagttggaagccaaaaaaattagggcaagtatgaatgacttcgataggttccgacttaataatgccaggaggaccaggagtaagattactaccaacgccttcttgttgcttaagaaacaagccaaaaaggccaagaaaactgaggtgaaaagtgacaagaaagctaaggataagaaacctgacgctaaaaaaggtgctgctaagaaagcagaaaaaaagaagtaaaatgtatttttaataaatgaacttttgttttaaaaaattgga

SEQ ID NO: 583 - DNA, 6502 bp, artificial sequence
  Nezara viridula
atgtggcaatgtgtggggttgatacctctatcccttatctaaagtagttccacagaatacagttctgcttgcaaaggcatttttatccagtttattcgtgttgagttgactcgttgatagttctctgactgtacgaagttaaactcttgccttttctcaaaactattattaaaagtgggcgtaaggttattcttatgtgtaactggtgtagccatgttgaattaaagattgataatatccatggtgttggaggtggaagtgattgtttagctttcctgaggggtcaatagggtaatttaaagaagattaagtatttagttgaagctattttataatatccaagatgtctcaaatattaccgatacgcttccaagaacatttacagctttccagtgtaggaattaatccaactagtgtaggctttaacacattaacaatggaatctgataagttcatttgtgttagagaaaaagttggagaaacttctcaagttgtgataatagatttaaatgatactgctaatccaataagaagacctatttcagcagattcagctatcatgaaccctgctagtaaagtaatagcgctgaagggaaaagctggtcctgatggaacaaccactcagaaaacactgcagatatttaatattgaaatgagaagtaagatgaaagcacataccatgactgatgaagtagttttttggaaatggatttctcttaatacacttgctttagttactgaaacatctgtttatcattggagcatggaaggcgactcgcaaccagtgaaaatgtttgatagacattctagtctgaatggttgtcaaattattaactacagaacagatcctaagcaaacctggcttttacttatcggaatctctgctcagctaaatcgtgtagttggggctatgcaattatattcagtagagcgcaaatgctcacagcccattgaaggacatgctgcatcatttgctcagtttaaaatggagggaaaccctgatgtatcaactttgttttgctttgctgttcgtacacttcaaggaggaaagcttcatataattgaggttggacagcctcctacaggaaaccaaccattctcaaaaaaagcagtggatgtattttttccagtagaagcccaaaatgattttccagttgcaatgcaggttagctctaaatatgatgtaatctatcttattacaaagtatggatacattcatttgtatgatttggaaacagctacatgtatttacatgaaccgtattagtattgatactatatttgtaaccgctcctcatgaatcaactggtggtatcataggtgtgaatagaaaaggccaggtgttatcagtgagtgttgaagaggaccatataatcccatatatcaataatatattacaaaatcctgatctagcattacgcatggctgttagaaataatctagctggagctgaagatttatttgttaaaaagttcaacatgcttttccaaaatggccaatatgctgaggctgctaaagtggcagcaaatgcacccaagggaatacttagaactccgcaaaccattcagcagttccagcaaataccaaatccccaaggtcaaacatcccctctccttcagtattttggaattttgcttgatcagggtcaattaaataaatatgaatccttggagttatgcagacctgttctggctcaaggaagaaaacaattattagaaaaatggctgaaagaagataaacttgaatgctctgaagaacttggagatttagtgaagcaaacagatccaacacttgctctgtcagtttatttaagagctaatgttccaaacaaggttatacagtgctttgctgaaacaggacaatttcaaaagattgttttatatgcaaaaaaagtaggctattcacctgactacattttcctgctccgaaatgtgatgcgtgttaatccagatcaaggtgttagctttgctcaaatgcttgttcaagatgaagaaccacttgctgatataaatcagattgttgacatactgatggagcaaaatatggtacaacagtgcacagctttccttttggatgcccttaaaaataatcgaccttcagaaggccctttacaaactaggcttcttgaaatgaatttgatttctgctcctcaggttgctgatgcaattcttgggaaccaaatgtttacacattatgatagagcccacattgcacagctttgtgagaaggctggtctactccagagagcattagaacattatacagatctttatgatataaaacgagctgttgttcacactcatcttcttggccctgattggcttgtgggatactttggtaccctttctgttgaagattctcttgagtgtctaaaagccatgttaactgcaaatattcgacagaatttgaatatatgtgttcagattgcaactaagtaccacgaacagctgacaaccaaggctttaatagacctttttgaatcattcaaaagttatgaggggttgttttatttccttggctccatagttaatttcagtcaagatcaggaagttcattttaaatacatccaggcagcctgtaaaacaggacagataaaagaagttgaacgaatttgtcgtgaatcgaattgttataatccagaaagagtgaaaaattttttgaaggaagcaaagttgacagatcaattaccacttattattgtttgtgatcggtttgatttttgtcatgatttggttttatatttatacagaaacaatttgcaaaaatatattgaaatttatgtgcaaaaggttaatccatctcggttgccagttgtaataggaggattattagatgttgattgctctgaagacattattaaaaatttgatgatggttgtaagaggacagttttcaactgaggagcttgttgctgaagtagaaaagcgaaatcgactgaaacttctgcttccttggttggaaactcgtgttcatgaaggttgtgttgaacctgctactcataacgctctagcaaagatatatattgatagtaataacaatccagaacgattcttgagggaaaatcagtattatgatagctgtgtagtaggaaagtactgtgaaaaacgggacccacatttggcgtgtgtagcctatgaaagaggtcaatgtgatagagagctcataaatgtttgtaatgaaaattctctctttaaatcagaagccaggtacctggttagacgcaaagatcctgaattatgggctgaagttcttaatgaaaacaatccttacaagagaccattaatcgatcaggttgtccaaaccgctctttctgaaactcaagatcctgaagatattagtgtgactgtcaaggctttcatgactgcagatttacctaatgaacttattgaacttctagaaaagattgttcttgacaattcaatatttagtgaccatcggaatcttcaaaatctcctcattctcactgccataaaagcagatcggtcaagagtcatggaatatatcaaccgtttagataattatgatgcacctgatatagcgaatattgctataaattatcagttatatgaagaagcatttgcaatattcaagaagtttgatgtaaacacttctgctattcaggttttaattgaaaatgtaaacaatctcgatagagcctatgaattcgcagaacgttgtaatgaaccagctgtgtggagtcagttagctaaagctcaactacagcatggccttgtaaaagaagcaattgattcattcataaaagcagatgacccttctgcttatgttgatgtagttgaaacagctcacaaaacagaaagctgggaagatttagtccgttatttacaaatggcaaggaaaaaggctagagaatcttatattgaaagtgagctaatttatgcttatgctcgcactaaccgattggcagatcttgaagaatttatctcaggtccaaaccatgctgatattcaaaagattggtgataggtgttttgatgacaagatgtatgaacctgctaaactactttataacaatgtttcaaactttgctagactagctattacactggttcatttaaaagaatttcaaggagccgtagacagtgcaaggaaagcaaacagtacaagaacttggaaagaagtttgttttgcttgcgtggatagtgaagaattcagattagctcaaatgtgtggtttgcatattgttgtccatgctgatgaactagaagacctaatcaattattatcaggaccgaggatattttgaagagcttataaatttgttggaagcagcacttggtttagagcgtgctcatatgggaatgtttacagaattagctattctttactccaaatacaaaccaggaaaaatgagggaacatttagaattattctggtctcgagttaatattccaaaggtcttgagagctgctgaacaagctcatttatgggcagagctagtttttctctatgataaatatgaagagtatgataacgctgtatctgcaatgatgaaccaccctactgaggcttggagggagggccattttaaagacataattaccaaggttgccaacattgaactatattacaaagctatacaattttatttggattataaacctctccttttaaatgatatgttgttggtattggctccaagaatggaccatactagagcagtgaatttctttgccaaggttaaccatttgcaattggtcaaaccttatcttcgctcagtacaatcattaaataataaagcaataaatgaagctctgaacaatcttcttatcgaagaggaagactttcagggtgttagaacatcaattgatgcttttgataattttgataatattgtattagctcaaaagctagaaaagcatgaattgattgaatttaggaggatagcagcttatctgtacaaaggaaataatcgatggaagcaaagtgttcaattatgcaagaaagacagacttttcaaggatgctatggaatatgctgcagaatcaaagaattctgaagttgctgaagaacttttagcatggttcttggaaaaaggaaatcatgactgttttgctgcttgtttgttccaatgttatgatcttcttcatcctgatgttattctagaacttgcatggcgacataatatcatggattttgctatgccatatattattcaagtgacaagagaatatatttccaaggttgataaattggaagagtctgaagcaagaaggttagaagaaagagcagaacaagatcataaacctatgatgatgccggagccacagctaatgttaactgctggcccaggaatgataggaccaggtttttcccctgcttatcctaacacttttaccactggcatgccttatcaaggttatggcatgtaggtaatatcaaatgtgatcaacttcttcgtattatgcaactaaagtgaatggtctaacctccatccagcctaatggaaactgaaatgtataggaattaaggaataaataagtctatagttgctatagaggttctttttgttttctcaacacatgatctaattcaaggcctcttatactgtggttctgtcttcattaaaaaataaattgtataaagtttaatactgccttcataagtgtgcttttaataaatatcatgcgcatataaactttgtaaaaatctatatgtatgttatgatatttctgttgatattcataaaacttatttagtcctggatggtaaagttagcatcaacttatgattagttaacggatagtctattccgttactacatatattttttatagtatttaatgaatttgttaactatttaagtttatgttatgcattccatttcttcacacatatacacatacatagactcacatttacacataatgtgtatgtgtgtaatattgtgttctagagaatagaaacactaactatttattgtggtattatattgttagcttgtgtgaatatttgttttattagtaaaatgatttactgctacatttgaaaaattgtttatatatttaaattatgaatttatctaatttttgtgtttcaatgttatgttactttttgtattagttatttcttgaataactatgttatttaggtgtattattattagtaccaacatgcaaaatatgcactatagttcaacatataaatagaccttatggaaatatgtaaagattgaaaaatatactctttattattagaatcaaattgtatttaaaaaaatatatataagtaattgttaatggttattatatcttatggatgtaatgagtccaaagaggagaaagatcagttatgtagagcaatgctctggcttcatatccagatatgtttttgtattatataagtttacattgctttcaatgtttttgttttcttttaaagtatataaatgttgctggatatgaaggtggagtcaaaagttgaattaaataattattttaattttataatttaattttttttaataaatacactttatattttgttta

SEQ ID NO: 584 - DNA, 645 bp, artificial sequence
  Nezara viridula
tgatgatgatcaagttggttttgtttccatgcaaggtgctccatctttctttagtgaggtggtgttcgggttcaagtacttcgtgtatggttctactattggtgaagtaagtgagaaccgtcagttatgcagattttcgtgaaaaccctcacgggtaagaccattacccttgaggttgagccttcagatactattgaaaatgtgaaagctaaaattcaagataaagaaggtattcctcctgatcaacagcgtttgattttcgctggaaaacagttagaagatggccgcacactttctgattacaatattcagaaggaatctaccttacatttagtgttaaggctcaggggaggtgcaaagaaacgtaagaagaagaattactccactccaaagaagatcaagcataagaagaagaaggtcaagctagctgtgcttaaatattacaaggttgatgagaatggtaaaatcagcaggttgagaagggagtgtccctctgagcagtgtggtgctggtgtcttcatggccgccatggaggataggcattattgtggaaagtgtgcctacacccttgtcttcaataagccagaggataaataaatgtttttaatataaaactaccgttattaaagtttttaataaacggct

SEQ ID NO: 585 - DNA, 747 bp, artificial sequence
  Nezara viridula
cgcactcgtgcaacgatacgtggctacttttcttctgcacaagatcgtccattttactctgaactcttctctcgttaggacctttctctccgttagttttatgctgttttagccaaccatggttaatcggagggttccatcagtgcatagtaaaacctatgtcactccaaggcgtccttatgagaaggctcgtcttgatcaggaattgagaattattggagagtatgggttaaggaataagcgtgaagtatggagggttaaatatactcttgctaaaatcaggaaagctgcccgagaactgcttactcttgacgagaaggatcctaagagattgtttgaaggtaatgcgctcttgcgtagattagtaagaataggagtattagatgaagctaaaatgaaacttgattacgttttgggtcttaaagttgaagatttcttggaaagaagacttcagactcaggtgtttaaacttggtcttgctaaatcaattcaccatgctagggttttgataagacaaaggcatattagagtaaggaagcaggttgttaacatccccagcttcattgtgaggttagactcacaaaaacacatagatttctcattgaaatcacccttcggtggtggccgccctggacgtgtaaagaggaagaactccaggaagggaaccactgctgcagctgcagaggaagatgaagattaattgtttaagtttgttttcctaaataaaaaatcttcctggaaggcata

SEQ ID NO: 586 - DNA, 2055 bp, artificial sequence
  Nezara viridula
tgaagcacagttgggcaggttattaaacagcgtttgtagattgatttctgtcaggtaatcatggctggtgtattagctactgagagaacccttcctggtttttcgtttgaaaattgtaaaaggaattccatcttgctgcagcaaggatttaaaccacccactgcccagaagactggtacaacaattgttggaataatatacagagatggtgttattcttggagctgataccagagctacagaaggtagcacggttgctgataaaaattgttccaagattcattttcttgctgacaacatctattgctgtggtgctggtactgctgccgacacagaaatgacaactatgacaatcatgtcgcaactggaattacatcgtctgaatactggacgccctgtcagagtttctacagccaaacagcttcttaaacagttactcttcaggtatcaggggcacattggagcagctcttgtagttggtggggttgatgttactggacctcttctttattctatacatcctcatgggtcctctgagtgcttgcccttcacaacaatgggctctgggtctcttgctgctatgacagtacttgagtcttcatggaaacctgatttgaatgaagaagaaggtaaagtgatagtccgtaatgctattgctgctggtatattcaatgatcttggttctgggagtaatgtggacatttgcatcatccgcaaaggttctgttgattatatccgcccctttgatgttgctaatctcaaaggacagaaacaaaataattatcgttttcgtcgaggaactacaggagttctttctactaggataattcctttggttacagaatcagaagaaataaaaaaaactgaagtggaatcaatggatacatctgcttgataatttttataatatattattgtattacttttttttttgtttctttatctagaagttgaaaataaataatatttctaaaatcaggtgtttaaaggttttatccatttctttgttttttaagcaactgaaatataattttctttccccaaaatctatgtgtgatatttttatttatattccagaatgtaaataatcctatctatctggaataatgagaccaggactattcaagacaggtatctgtaatctgtaaataacaacttgctaatatttgtaaggtagtgtaaaataactgaggacctgagtgggatactgtgtttcactctcacaatttgcttttccatccatcacgtctgagacaacagacaacatttttcaaaatgttaagacagacctgataaaataaaccgtaatatgacaagtaatattgggttgtttcatatgaaatttcagttttcacaggaaaggttttttagtaaaacaacttttataatcataacatttttatttaaattatttaaattatttatcctcattttctgtacatttttcccaacttgttatcatcttttcaatcccagaactgaataattcagggttttgtaaagaaatgagtttttgacctgataatcattttgtccaggtctttcatcgatatttacccaatggcctgactgacacctgtggtcatatgcaatccactttcatcacatatgattattatttcgagaaaaggcttgtttttgcttagtaagcagtgaaaatcataccttactgctgctggccattaagttcctgaggtctgaacggcatggtaatgtttctggcagctgtggctgccgagtgtccaagtttaaactcataaaaaacattactcgaaaattgggtaaaccttgtgtaatcaataaattcttgtaaatcgaataaaaaaagagaggattattaatggctcattatgatctgtaaacaacagaagtccacaaatcctattttaaatttctgaattaataaaaacagacatttcaaataaaatgacccaattgtatttctaatgtttattgatgttaagaatgttttattttctatttttgtcatatttattctaatctaacatcttgcatatggatcattctctcagtagaattaagcaaaacttgtgag

SEQ ID NO: 587 - DNA, 858 bp, artificial sequence
  Nezara viridula
aacaatgataaaagtgtaggttatagtgactcaggtcaggttattacacttttgcttggtaatcatgggttctgagagatacagtttttctttgactacatttagtccttctggaaaattagttcaaattgagtatgcccttgccgctgttgcagctggagctccatcaattggtatcagagcgtccaatggagttgtattggctactgaaaacaaatacaaatcaattttatatgaagagcatactattcaaaaagtagagatgataactaaacacataggaatggtctacagcggaatgggacctgattatcggctacttgtcaagagagcgagaaagatggcacaacaatatcagctagtttatggcgagcctattcctaccgcacagcttgttcaacgagtagctatggttatgcaggagtacactcagtcaggaggtgtgaggccttttggagtttctttactcatctccggctgggatggggataaaccatccctcttccagtgtgatccatcaggagcatacttcgcctggaaagctaccgcaatgggaaaaaactttgtcactggcaaaacattcttagaaaagaggtacagtgaaactttagagttggatgatgctgtacatactgcaattcttactcttaaagaaaacttcgaaggccaaatgacttcagacaatattgaggtcggtgtttgcgatgcacaaggattcagagttctggacccgaccacagtgaaggattatctggccaatattccataagtccattattaaagtttgattttataattaataaaaggtggtttctgaagattttctatgtataatgcctaatacagtcttatttttta

SEQ ID NO: 588 - DNA, 958 bp, artificial sequence
  Nezara viridula
atatgtatttgaaattatttcattcatccatagttggcagcactaggtattccttcaatgtcgacacgctgtaaacgttccttactatagaatggctcctgctaagaaaccagcaccagcctctaagaaggtgccgacaaccactgttacaagtggtaaagctggcaaagcaactgcaactgctacaaaggcagctccagcaccagctgccaaagcagctgcagccaagtcagcagcccccagttctgctaagccagcatcagctaagcaacctgccccagctcctaaagcggcacagcctaaggcccaagccaagcctgctgctcaacaacaaaaatccactaaaccacaacagcaaacaaaagctgccgctacagcaaaagctcaagccaagcccgcagctcaggcaaagcctgctgctccggctgcagctcctaaacaaccggctgctccagcggcagctggaacccaacctgccccagcagcacccaagaaagctccatcaggtgccgtgaagaaagcaacaactgcccctaagaaaagccagaatttacagaaaaagtcccatcaaggtgttagaaaacaagtgttaaaaggaaaaggacaaaaaaagaaaaaagtctcattaaagtttataattgactgtactcatccatatgaggacaaaattatggatgtcgccaacttcgaaaaatatattcaggagaggtttaaagttaatggtaaaaccaacaacttaggcaataatgttaccttagaaaggaacaaaatgaagattactgttacttcagatgttcatttccccaagaggtacttgaaatatttgactaagaggtaccttaagaagaacaatctgagggattggctcagggtagtatccagttctaaagacacttatgaactgaggtacttccagtttaacagccaggatgatgatgatgaagaggacaatgattaa

SEQ ID NO: 589 - DNA, 532 bp, artificial sequence
  Nezara viridula
ataaaaacaaatataccgtaattgccataagagtttgtaagctagagagcgacacagtgcgcagctttcattcagaaggctttggtagggttctttagcaagtgcttcgtgttcggggtatatctgttataattttacaatgaccaagaaaaggaggaatggaggaagatctaaacacggtagggggcatgtacaagcagtccgttgtaccaactgtgcccgttgtgtaccaaaggataaggctatcaagaaattcgttatccgtaatattgtagaagctgcagctgtgagagacatcacagatgctagtgtttactcatcataccaattgccaaaactctacgctaaactgcattattgtgtatcatgtgcgatccactctaaagtagtacgtaatcgttctaaggctgagagaagaattaggacacctcctcagcgtaacttcccaagggatatgatgcgtcaaggtggaccccagataagaaaataatctttttcaaactaatgttaataaaaaccatttttaattatt

SEQ ID NO: 590 - DNA, 1061 bp, artificial sequence
  Nezara viridula
tacccaaagccattacgatccgcaacgtgttcctgctggggccgtgctaagtaagtttggtgttaaagggaaatatttcttttagcgatcgggctgttggccgtttagaatggggttcgttaaagtcgtgaaaaacaaacaatactataaaaggtttcaagttaaatttaagaggcgacaagaaggaaaaactgactactatgccaggaaaaggttaattgtacaagataaaaataagtataacactccaaaatatcgtctgattgttcgcctctccaacaaagatattacttgtcaggttgcttattcccgcattgaaggtgacaaaatattgtgtgctgcatacagccatgaacttcctcattttggaattaaagtaggattaaccaattatgctgctgcttactgtactggtcttcttttggctaggaggttacttcagaaattgaagttagatgctttatatgaaggtaccactgatgtcactggtgatgagtacaatgtagagaacttggacgaaggtccaggagctttccgttgctacttagatgttggtttaatgaagaccagtgctggagcccgtgtttttggagcattgaaaggtgctgttgatggaggtcttaacatccctcacagcatgaagagatttcctggttatgattttgaaagcaaggagttcaatgctgaagttcaccgaaaacatatttttggaattcatgttgctgactatatgaggcagttggccgaatctgatgaagatgcttacaagaagcagtttagcatctacatcaaaaatggcattgttcctgatgctatcgaagacatctacaagaaggcgcatgcagcaatcagggagaatcctgcccctagaccgaaggtaaggagtaaggaagccatcaagaagagatggaaccgtgctaagcttacccttgcggagaggaagaattgtattgcccaaaagaaagcagcatttttaaagaaaatgaaggccggagaagttgatgcctaatttgttaaatttgttgcttttacttttgataatataaaattcctcttttaaa

SEQ ID NO: 591 - DNA, 1563 bp, artificial sequence
  Nezara viridula
gccgacaagaggagccccccaccagtcagtgagaccctaggattcgcgggtgtctgtgtcgagacctccttcagtaatatcaggttcctgtccttaaaccaaaagcaaaatggcggatgatgaggcgaagaaggcaaaacaggccgagattgagcggaagagagcggaggtccgaaagaggatggaggaggcctcaagaggcaagaaggccaagaaaggtttcatgacgccagacaggaagaagaaactccgacttctgctgaggaagaaagctgctgaagaactgaagaaagaacaggaaaggaaagcagctgaaaggaggaggatcattgaggagcgctgtggaaaaatatgtgatgttgacaacgccagtgaagcgaccctgaagaaaatctgccaagactatcacaagcggattgatgctttggaacgcagtaaaattgacatcgagtttgaagtggagagaagggaacttgagattgcggatcttaacagccaagtcaatgatcttcgtggcaagttcgttaaacccaccttgaaaaaggtttccaagtatgaaaataaatttgccaaactccagaagaaggctgctgaattcaacttcagaaatcaactcaaagttgtaaagaagaaagaatttacccttgaagaagaagataaagagaaaaaaggaggaatcgtcgactggtccaagaaggatgaaaaggcaaaggtggaagtagaagacgaggatgaagaatctgtatcagaagcgctaccaagcgccgccgaagagacaatagcttcagaggccagcgagctgccacaagatgaaccacctcctccactggaaccagagcccgaacctgaacctcttcctccgccacctccaccaaaaacagaggaagatttgtggctattcctgcgtgaggcagttacccaagcaaatcctctatccattgatgaattgcttcacaaattacttgatacagtaaacgcagtaccccaagatttcttagagcctgttgtagaagcttcaattaaaagatctcaaagtatgcagagtatggatctttcccacgcagaatctcttccggccgacggtgaaccaccaaaggagggtgagcctggcgaacaacccccagcaactgaaggagtggctggcgtccctgctgagggagaggccaaagttgaacagggaggagaagggaatgcggcggagaaagcaccacaagcagaaagcccggctgctgaaagtgctcccgtgcaggaacagcagcctgctgatcaaccaccagcacaatcaccaaccgaaccaccagcacaagtaccaaccgaaccaccagcacaagtaccaactgaaccaccagcacaagtaccaaccgaacagccagccgcgccaccggcgggggaacaacccccaccaccacaagcggaacaaccccaaccacaaatcgtagaagctgcagcttaaaaataaactgaaacgaggaatacatgatttggaattctaatattactccttgatatttgaagataacaaagctcttgtaaattatttttattacaataaatgtttcataa

SEQ ID NO: 592 - RNA, 514 nt, Halymorpha halys
ugaucaaucuaacugugccaaacguccauuuucuuaccuugugguucuacagcguuuucucuagguuaguccuuucguuggacauccaguaucaucgaguuaaagguguuuauuuauuuucgaaauggcgccuaaggcuccuaaguaugaaauggccguuggccuuaaaaaaggccacagaacuaccaagauuguaaugggaaaaucuaaagcagauaaaaagcacaaaguuaggccaucucgcuugaagggcagacaaacuaagcauaccaaguuugugagagaucuaauuagagaaguuuguggccaugcaccguaugaaaagagaggaauggaauugcugaagauuuccaaggauaagagagcuuugaaguuuuugaagaggaggaucggcacucacauccgugcuaagaggaagagggaagaacuuagcaacauucuuacucagaugcguaaggcacaugcccaacaaaaauaauuguuuuacuuucuaauaaagucuuuuaaaaauuuu

SEQ ID NO: 593 - RNA, 1284 nt, Halymorpha halys
cugauaucgaaaagugggcugggcacuuuuacugacuguggccaucuaaccuucgucagauuacaaguuacauacuuuuuacuuucaggacaguaaauacuaauuuaacaaaaugucucuuagcgacgcagauguacaaaaacaaauuaagcauaugauggccuucauagagcaggaggccaaugagaaggcagaagaaauugaucaaaaagcugaagaagaauucaauauugagaagggaaggcuuguucagaaucaaagauugaagauaauggaauauuaugaaaggaaagaaaaacagguggaacuucagaaaaaaauucaaucuucaaauauguugaaucaagcacgucucaaagcuuugaaaauacgugaagaucauguucgugaugugcuugaugaugccaggaagagacuauugcaaucagucaaagaugaggcacguuacagagauauucuugugaaacuuaugcuucagggguuauaucaguugauggaagcagaaauuuugguuagaacucgugaaauggauggcccacuugucagcucaguguuuccugaugugcuagugaaauacaaggaaguuucagguaaggauuugcagcuuaaguuggauaccgaauuauacuuaccaucugaaugugcugguggcauugagcuuuauacugccagaggccguauaaagauugcuaauacucucgaauccaggcuugaucuuauaucagcacaauuauugccacaaauaagaacaucuuuguucgguagcaaugugaaccguaaauucaaugacuaaauaucaguaauucagcuuaaaaaaaaaguauaauaauaaggaaauuaaucaguucuaccauucugugagguacuaguuaguaucuacuuaguuauguggaauuuaaaaaucucauuuuccauuuuaguguuuuuauuuuaauugcaaaaaaaaaaaagaaggagaagaggaauauguaacccuuuaguauuuugcuuauuaauuuuuuucuuucacagaauggugugaacuuggcaauugauuccuuuucauaacacacuuacauuccauaguauuuugucuuaaauacugaaaaauaucaauaaaaacaaacccgaaauaauaaggaaauugguaauuaaccauucugggccuuccuuuuaucccauaaauuuuauggauacuuaauuuuauauuuuaaaauaggugaggguugagaaacauuucugaauuuuucccucuaaaaguuuacuguuuaugguguauauaacauuguaaaaaaaaaaaaaaaa

SEQ ID NO: 594 - RNA, 577 nt, Halymorpha halys
ccuugaacagcuguuacuacauucguuccugguuagucuguucugguucuucaguuaucuaaauauuaucgaguuucuuccuuaauaauuuaaauggcuagucagacucaaggaauucaacaauuauuggcggcugagaaaagagcugccgaaaaaguugcugaggcgaaaaaacgcaaagcuagacgucucaagcaagccaaagaagaggcccaagaagaaauugaaagauauaagcaagauagagaaaaacaguuccgagaguuugaagcccagcauaugggcucacgagaagauguugcggccaggauagaugcugacacccgccaaaagauugaggaaaugaaugaagcaguuaaugcuaacaaagaagcgguuauucaaagaauuuuggaauugguuuacgauaucagacccgagaugcauaagaacuacagagcaccaaauuaaauaaaguuaucaggaguucaucuaucaugauucccuuaaaauuuuucuguauuaauagcuaugguguguggaaauuuaauauagaguaaacuucuuguaaaauuaacaauauauuauuuuuuucuga

SEQ ID NO: 595 - RNA, 1591 nt, Halymorpha halys
augucuacaucuaaaacagaagaaaagccuaugugggaugaaagaaugguucaugaacccgaagauaucagaaaugagaauuccuuauaugaaaucguuagucguaacuaacuucuugacgaaaguaccaagauaaugaaaagugaaguuaugcguguuagucaugagcugcaggcacaaaccgaaaaaauuaaagaaaauacagagaagauuaaaguaaacaaaaccuuaccauaucugguuucaaauguuauugaguuacuugauguagauccagaagaaacugaggaagauggugcugugguagaucuagaugcccgucguaaagggaaaugugcagucauuaagacuucaaccagacagacuuauuuuuugccaguaauugguuuagucgaugcagaaaaauuaaagccaggugaccuuguuggagugaauaaagauucuuauuuaauccuugaaacuuuaccugcugaguaugaugcccgaguuaaagcaauggaaguugaugagagaccaacagagcaguauucugauauugguggacuagauaagcagauucaggaguuaauugaagcugucguucuuccuaugacacacaaagaaaaauuugaaaauuuaggaauucauccaccuaaaggugugcuacuuuauggaccuccuggaacaggaaaaacuuuguuggccagggcaugugcagcucaaacuaaaucaacauuuuugaaacuugcugggccccagcuaguccagauguucauuggggauggggccaagcuuguuagagaugcuuuugcucuugcuaaagaaaaaucuccagcuauuauauuuauugaugagcuggaugcuauugguacaaaaagauuugauucugaaaaagcgggugaccgagaaguucaaagaacuauguuggaacuccuuaaccaguuagauggauuuaguucuacagcugacauaaagguuauugcugcaacaaaucgaguagauauuuuagauccugcccuuuugcguucaggcagacuugacagaaaaauugaauuuccucauccuaaugaagaugcuagagcucguauaaugcaaauacauucacguaaaaugaauauuagcguugaugucaauuuugaagaacuugcucguucaacugaugauuucaauggagcucagugcaaagcaguaugcguggaagcagguaugauagcauugaggagaggagcuggaguaguuacucaugaagauuucauggaugcgauauuagaaguacaagcaaagaagaaagccaaccuuaacuauuaugcuuaauuaucuuuugaaauugugcagaaacucacuuccauucuuguuuuggagaguaccugccaauaacuguuauugccuucuauuauuauaaacauguaaauaugucuuucuguuaucaaaccaacauuagauuuucaucuaauucagaaagucacuacaaucaaaaaaaaguuuugucaauucuuuuuuuuuuuuuuuuuuuuuuuaauuuuaguucaaacagaauuaaauuuuccauaucaguuacuaauuuugucuuguuugaaaugaguuucugccauauuuaauauuuaauuuguau

SEQ ID NO: 596 - RNA, 564 nt, Halymorpha halys
guugguacuggcaccauccuaauaacucaccaccauauugaagaucccacguacagaagucuuuugacuacuagaggaucuucagaaugcagaucuucguuaagacccucacggguaaaaccauuacccuagagguagaacccucugauacuaucgaaaaugugaaagcuaaaauucaagacaaagaaggaauaccuccagaucaacagaggcuuauuuuugcugguaaacaauuggaagauggaagaacucucucugauuacaauauacaaaaagaaucuacucuucacuugguucuucgucuuagagguggcgucauugaaccaacccugaagauucuugcucaaaaauacaauugugauaaaaugauuugccgcaaguguuaugcaagacuucaucccagagcaacuaacugccguaagaagaaauguggucauaccaacaauauccgccccaagaagaagcugaaguagauuauuugccuauuuccuauccuggauccaaaaaauuuucuuuauuacauauaaaaccaaguuuaaauugauaugaaauaaaaauauauaa

SEQ ID NO: 597 - RNA, 1537 nt, Halymorpha halys
ggcgaucgcaugcgcaguacaguuucguuguucuauggacaccaucaucacuuuucugacugucuagaaggcuguuccuagggaccuaaacuaaguuugauaccguuugcugacaauccaacuggcucaaaagaguccucuguuaguaauagguuuguuccaagaaucaaucuugaacuaaguaacgccaaaguuccuuuaagaagaauuaggaaccuccucuguuuguuaaccuguguauauucgaaugagcaagcaaaaugacggcuucgcaagcaauggaaccaaauagagaaaaggcuuuacaagauuaucguaaaaaauuacuggagcauaaggaaguagaaguccgacuuaaagaaaugagagaccaguuaaaagaucuuaccaaacaauaugauaaaucugaaaaugauuugaaagcccuccaaaguguuggucagauugucggagaaguacuaaagcagcuuacugaagaaaaauuuauugucaaggccacaaauggcccaagauauguuguugguuguaggcgacaacuugauaaguuaaaacuuaaaucuggaacuaggguagcauuggacaugacaacauugacaauuaugagacacuuaccgagggaaguugauccauuaguauacaauaugucucaugaagacccaggagaugucacauauucugcuauuggaggucuugcagaacaaauuagggaacuucgugaggugaucgagcugccacuauugaauccugaacuguuucaacguguggggauaacuccuccuaaaggaugucuacuuuaugggccuccugguacuggaaagacauuauuggcccgagcuguagcaagccaauuagaugcaaauuuccuuaagguaguauccagugcuauuguugacaaguauauuggugaaagugcucgucuaaucagggaaauguuuaauuaugcaagagaucaucagccuugcauaauuuuuauggaugaaauugaugccaucggaggucgaagauucucggaaggaacaucugcugaucgugaaauacaaagaacccuuauggaacuucugaaucaaauggauggauuugauucacugggacaggucaaaaugauuauggcuacuaaccguccugacacccuggacccugcucuucuccguccuggcaggcuagacaggaagauugaaauuccacugccgaaugaacaggcaaggcuagaaauucuaaagauccaugcugggccuauuucuaaacauggagauauugauuaugaggcuguagugaaguugucugauaauuucaauggagcugauuugagaaauguuuguacugaggcuggucuuuuugcuauucgagcugaaagagaauauguaaugcaggaagacuuuaugaaagcugugagaaaaguagcugacaacaagaaauuggagucaaaacuggauuauaaaccaguauaaucaguuaaucauuugguguuaauaauaauucauuaacuuaaucuuauauuuuguauaugcaguacuaaauucgaaauacauuuuuuuuc

SEQ ID NO: 598 - RNA, 1482 nt, Halymorpha halys
auaaaaaaaaauuuaagguuaugguguaagaauguauggauuauucugaaaccuucuuaaaaucuucauuacaaacaaaagaaagaucacauugcuugaugaccuagcguuucauuuaguaacauggcgggugcaauguuguuugagagguccgucucuuccagagauagggauaauagucgaauucuuccaacuucuaauagaaaugucgacgaugacaacgaugaagaagagaucaagaauaaggagcaaggaauuuugcaguugggugagcaauacaagaaagaaggcaaagcuaaagaguuagcagaacuuaucaaggcaaguagaccguuccuaagucaaauuagcaaagcuaaagcugcaaaauuggugcguucuuugguagauuauuucuuagaucuugaagcuggaaucggaauagaaguucaacuuuguaaagagugcauagaaugggcuaaagaugaacacaggacuuuccucaggcagucacuggaagcuaggcuuauugcucuguauuuugacacaggaauguucacagaagcacuccagcuuggcucaagucuccuuaaagaauugaagaaguuagacgauaaaaauuugcuuguagaaguacuucuauuggaaucuaaaacuuaucaugcuuuaagcaaucuuucuaaagccagggcugcucugacaucagccaggacaacugcuaauucaauauauuguccaccuaaaaugcaagcagcccuugauuuacaaucugguauauuacacgcagcagaugaacaagauuucaaaaccgcuuauucauacuuuuaugaagcuuuugaagguuaugacagugucgauagcccgaaagcguugguugcucuuaaauacaugcuuuugaguaaaaucauguuaaacacaccagaagaugugcagcaguuaguuagcggaaaacuugcucugaaacaugcugguaaagauaucgaugcaaugaaaucggucgcucaagcuagccauaagagaucacuugcagauuuccaguugacguuaaaaaauuauaagaaagagcuagaagaggauccaauuguucgagcucauuugggcacacuuuaugacaauauguuagaacagaauuuguguaggaucauugagccuuauuccagaguucagguggauuuuauuucuaaaucaauuaaacuuccucuuccccaagucgaaaagaagcuuucucaaaugauucuugacaagaaguucaacgguauucucgaucaaggugacggaguucuuauuguguucgaagaugcuauuguugaaaaaacuuacgaaauggcccuggaaguuauuaacaguauggguaagguuguagacacauuauaucaaaaggcuaagaagcuaucuuaaguaucauuuuacaguucucaaauuucgaaaaggcugaaaauuauuuuuucacauguacaacuaacuaauagauaucaggaccuuauuaaagcuuuuccauuauaa

SEQ ID NO: 599 - RNA, 606 nt, Halymorpha halys
uauugguacagguaauauuagcucuuuguaacagcagaaccaucuuacuagguuaggcuguguugacaguacagcacguggauuauacgugaaaggccugaaaaaugaccaacucuaaggguuaucgacgagguacccgugacuuguuuucacggggcuacaggaaacauggcgucauuccacuuuccacauacaugaaagucuacaaaguuggagacauuguuucaauuaagggaaauggugcugugcagaaggguaugccccacaaaaguuaucaugggaaaacaggacgaguuuacaauguaacuccuagagcguugggugugauuguuaacaaaaggguucguggaaaaauauuaccuaagaggauuaacauccguauugagcaugucaaccacuccaagugccgugaagauuucuugaagcguguacgagaaaaugaaaggcucaggaaagaggcuaaagaaaaggguauucgaguugaauugaaaagacagccugcccagccacgaccugcucauuugauaacugucaaggagccuccaauaaugcucgcuccuauaccuuaugaauuuauugcuuaaaaauaaauguguuuuuuauuga

SEQ ID NO: 600 - RNA, 750 nt, Halymorpha halys
gaaaacugacuuggaauuuuuaaauagacaauuguauaucuaguuaucuauggucuccauguuguuuucuuucaguguggaacuuagggauuaccaugaguucauugaaguuacagaagaggcuagcugccucuguuaugagaugcgguaaaaaaaagguuugguuagaccccaaugaaauuaaugaaauagccaauaccaacucaaggcagaacauccgaaaguuaaucaaagaugguuuuauuaucaagaaaccuguugccgugcauuccagagcccguguacguaagaauacugaagccaggaggaaagguaggcauugugguuucgguaaaaggaaagguacugcaaaugcaagaaugccagcgaagguuuugugggugaacagaaugaggguucuuaggcgguuacugaagaaauacagagaagccaaaaaaauugauaggcaaauguaccacgacuuauauaugaaagcaaaagguaauguuuucaaaaacaagcguguacuuauggaauuuauucauaagaagaaggccgaaaaagcuaggucuaaaaugcuucgugaucaagcugaagccaggaggcaaaagguuaaagaagcaaagaaacggcgagaagagaggauuacuuugaagaaacaagaaauuuuacagucauaccagagggaagaugaagcugcaacuacugcuaaaaaauaaauuuguuuuuuaaugugauccuucgggaaauaaauuuuuuuucuaaaaucaa

SEQ ID NO: 601 - RNA, 781 nt, Halymorpha halys
ccuccuauaucgaaggggucgccauugcaggcagccuuggccgaguaucgagaaagcucuucguucacguuaccguguuucuagaagccuucauuuacaaugggggcuuacaaguacauccaggaauuguacagaaaaaagcagucagaugccaugagguaucugcugcgaauuaggguuuggcaauaccgacaaaugaccaagaugcaccgugucgugaagccuucaagaccugacaaagcuagaagauugggauucaagaauaagcaagguuucugcaucuucaggauccguaucaagcguggaggcaggaaacgucccguuccaaagggugccacuuacggcaagcccaagagccauggagucaaccagcucaaaccgacaagaagucugcaugcuauggcugaggaaaaaguugguaggaaaugcagcggacuuaggguauugaacuccuacuggguagcgcaggacgccagguacaaguacuacgaagucaucugcgucgacccagcucacaaggcuauaagaagagaugcuaaagcuaacuggauaugcgacccagugcacaagcaccgugagaugcgugguaagacaagcgcugccagaaagucacgaggucugggcaaggggcacagauauucacagacaaagggagguuccaggaaggccgccugggugagaaggaacacccugcagcugcgcaggaagcgauaaucuugaucacccuuuuauacuuaaugaauuauuauauuaccuuuuaaaguauguuaaaaaaaaaaaa

SEQ ID NO: 602 - RNA, 1537 nt, Halymorpha halys
caucagauuaacaucaccaauauuuuagauccaaauuguauaauauuuaauacaauagagagccuuaaauauaaaaaaacaaacaaaaaaauacauaguaguauuauggaguaacuaucguuggagacguaucugaagguccuuguagcuaacaccccucgaucgaggaguccauucugaggcuggaaaccaacggcuccguaccuccuucauucccgucaauucuggucugguguacgcauuggcucuugccguaaacuuuuuuuucuguaagcucaauuaacccuuaaacaaaaugugugacgaagaaguugccgcuuuaguuguagacaauggauccgguaugugcaaagccgguuucgcuggagaugaugcaccccgagcaguauucccaucaauuguuggcagaccaaggcaccagggugucauggucgguaugggccaaaaggacaguuauguuggagaugaagcccaaagcaaaagagguaucuuaaccuugaaauacccaauugaacacgguauuguuacuaacugggaugauauggaaaagauuuggcaucauacuuucuacaaugaacuucgaguugccccagaggagcacccaguucuccugacugaagcaccuuugaacccuaaagcaaauagggaaaaaaugacucagaucauguuugaaacauucaacacuccagcaauguacgucgcuauucaggcuguccugucucuguaugcaucuggacguacaacugguauuguccuggauucaggagaugguguuucacacacuguaccaauuuaugaagguuaugcucuaccucaugccauccucagguuggaucuugcuggacgugaccucacugauuaccucaugaagaucuugacugaaaggggauacuccuucacaaccacugcugagagagaaauuguuagggacauuaaggaaaaauuguguuauguagcucucgacuucgaacaggagauggcuacugcugccaguucaaguucucucgagaaaucuuaugaacucccugauggacaaguaaucacaauuggaaaugaaagguuccgaugcccugaagcucuauuccaaccuucuuucuuggguauggaagcaugugguauucaugaaaccacuuacaauucuaucaugaaaugugaugucgauauuaggaaagacuuauaugccaacaccguucucucuggagguaccacuauguacccugguauugcugauaggaugcagaaggaaaucacugcccuugcuccuucuacaaugaaaauuaagaucauugcuccaccugaaaggaaauacucaguauggauugguggaucaauccuugccucccuuucuaccuuccagcaaauguggauuucuaagcaggaauaugacgaaucuggcccaucuauuguucacaggaaauguuucuaaaguggcugucaucacaugucaugccuacuuuuccuuccuuuguaugcuccuucuggagaccugcuuauucuuuuguauuauaauguuuauuauauuuguuuauuauuuuaa

SEQ ID NO: 603 - RNA, 1334 nt, Halymorpha halys
guauggggggcgguuauucccggugcggacggacggaggauaaagccugcggccaggcccccaccacgucacucgcuagcaaguugcccagggaagcggucugucuacagguguugaagcaaaccagaagcaagcaagaugugugacgacgauguugcugcccucguaguugacaaugguuccgggaugugcaaagccggcuucgccggagacgacgccccgagggccgucuuccccuccaucgucggcaggcccaggcaucagggagucauggucgguaugggccaaaaggacagcuacguaggagaugaagcccaaagcaagagagguauccugacccugaaguaccccauugaacacgguaucaucaccaacugggacgacauggaaaagaucuggcaucacaccuucuacaacgagcugcgagucgcuccagaggaacaccccauccuccugacugaggcuccccucaacccuaaagccaacagggagaagaugacccagaucauguuugagaccuucaacaccccagccauguaugucgccauccaggcuguacucucccucuacgccuccggucguaccaccgguauuguacuugacucaggagaugguguaucccacaccguacccaucuaugaagguuaugcucuuccccacgccauccuccgucuggaucuugcuggacgugauuugacugacuaccuuaugaagauccucaccgagcgugguuacagcuucacaaccaccgcugaaagggaaaucgucagggacaucaaggaaaagcugugcuaugucgcccuggacuuugagcaggaaauggccaccgccgcugccuccaccucccucgagaaguccuaugaacuuccugauggucaggucaucaccaucgguaacgagagguuccguugcccagaggcucucuuccagccuuccuucuuggguauggaaucuugcgguauccaugagacugucuacaacuccaucaugaagugcgacguugacaucaggaaggacuuguacgccaacacuguccuuuccggagguaccaccauguacccagguauugcugacaggaugcagaaggaaaucaccgcccucgcuccuucaaccaucaagaucaagaucauugcucccccagaaaggaaguacuccguauggaucggugguuccaucuuggcuucccuguccaccuuccagcagauguggaucuccaagcaggaauacgacgaauccggcccaggcaucguccaccgcaaaugcuucuaaacaucacgcuacauauuucuuauacuuauucgucuuuuguacuauguacaggcgcggacaacaga

SEQ ID NO: 604 - RNA, 1952 nt, Halymorpha halys
cuuccaaaucaucuucuaaaguuuaguuaugucacauagaguacuuuaaauuuugaugauaauuguaaaauuguaagcugaaaagcagaugauuuuaguuuuuuuaaaaaauacaguaacuuuauuuauauuuauaucgauauuuauugagcuaucaaauaagaaauuuugaccgguacacgucagcuuacguauugcugcuccagguuugacugccaacugucugugauaggugaaacuauguuuugcagcugaaguuuauuuacugguuuaaggacuguucuaucgcuuuugcaaccauggugcuaaucgcagcagcgguuugcacaaaagcugguaaaaccauugucucaaggcaguuugucgaaaugacaaaggcccgcauugaaggacucuuagcagcauuuccaaaauugaugucaucggguaaacaacauacauuuguagaaacugauucagugcgguauguguaucagccccuugagaaacuuuacauggugcugauuaccacuaaggccucaaauauuuuagaagaucuugaaacacuuagacuauucucucgugugauuccagaauauugccgcaauauggaagaaucagaaauuacugaaaaugcauuuaaucuuauuuuugcauuugacgaaauuguggcucuagguuacagggaaaguguuaacuuagcucagauuaggacuuauguugaaauggauucccacgaagagaaaguauacauggcuguaagacagucucaagaaagagaagcuaaaaauaaaaugagggaaaaagccaaagaacugcagagacaaagguuggaagccggaaaaaaaggcuacaaaacuccaaguauugcugguuucgguucgucaucaacauuuacaagcccuguuguugaaacuauugaucugccuaaaccuacauacacuccugcgaaacccgucuuaucagcgaaagcuaugaaacuuggugguaaaucuagagacguugaaucauuuguugaucaacuaaaaucugagggagaaaaugucauuucucaaguagcugcaaauaaaccuguaguggcgaaguuagcuucuacaccaaauauucauauggaagagguccaucuaaagcaggaagaaaagcugaugguuucuguugggaaggaugguggaauacagagcuuugagcuccacggucuuguaacauuacggauaacugaugaaaaauaugcgaagauaaaaguauaucucgacaauaaagauaagagaggaauucaguugcagacgcauccaaauguugauaaagaauuauucaaacugaagucacagaucgguuugaaaaauccaucaaaaccauuuccuuuagggacugauguagguguucugaaauggcgguaccaaucucaagaugaaucugcacuuccucuuaccauaaacuguuggccauccgaaaaugggcaaggaggaugugaugucaauauugaguaugagcucgaacauacucaucuugaauuaaaugauguuaccaucaacauuccauuaccuauuggguguucuccuguaguugcugagugcgauggugaguauaaacaugagucucgaaggaacuugcuccagugggugcuaccagucauagacaggaguaacaaaucgggagcaauggaguuuucggcaucuucuucaaugcccucagacuuuuucccuuugacaguaucuuuuacaaguaaacagcccuaugcagaucuaaaggcugucgaaguucuucauguugaugaugaaacuccuguuaaguuuucaagugaaacauuguuuuauacagaaagguaugaaauuguauaaagaaaaauacaaaauaugggggucauuugauagcuuugaaugaauauguguaauaauuguuacuuauaguguauuaauucauuuauauauauauauagcuuucuauguaaauuaaaauauaauugguuucuuuua

SEQ ID NO: 605 - RNA, 1650 nt, Halymorpha halys
uucuuaauuaaaaugcucguuuauaaauugaaauauaauuugcgcgcauggguacaaaaaccacacuucuuccugucuuaguccuuuccauagcaaauacuugaguggaacaugucgguaacgucgucugacaaaaggaaugaagauugggucggagagucuaaaaauggaccaagcgacaaagaacacuccuaugaugguccaccagggauggacccugaaggaaucaucgaauccaauugggaugaggugguugacaauuuugaugauaugaaccuuaaagaagaacuauuaagagguauuuaugcguaugguuuugaaaaaccuucugcuauucagcaacgggcaauuaucccauguguuaggggacaugauguuauugcccaagcucagucagguacugguaaaacagcuacauuuuccauuuccauauuacaacaaauugacacuagugcuagagaaugucaggcucugauuuuggccccaacucgugaauuggcccaacagauucagaaaguaguuauugcucugggagauuucaugggggccaugugccaugcaugcauuggugguacaaaugugagagaagauaugcgcaaacuagaaauggguguucauguguugguuggaacuccaggacgaguuuuggauaugauaagccgcagggcucuaaaaacaaacaccauaagaauuuuuguguuggaugaagcugaugagaugcuuucucgugguuucaaagaucagauucaugauguguuuaaaaauuugaaucaugaaguacagguuauauugcuuucagcuacuaugccuucagauguauuggaggucaguacaugcuucaugagaaauccuauucguaucuuaguuaaaaaagaagaacuuaccuuggaagguauuaaacaguuuuucguuuuuguugagagggaagaguggaaguuggauacucuaugugauuuguaugaaacucuaaguauuacccaagcuguaauuuucuguaauacaaggcgcaagguugauuggcugacugagaguaugcauaauagagacuucacuguuucugcuaugcauggggauauggaacaaagagagcgagauauuaucaugaggcaguuccguacugguucuaguaggguuuuaauuacuacagaccuuuuggcuagaggaauugaugugcaacaaguuucgcuugucaucaauuaugaucuuccaucuaauagagaaaauuacauucacaggauuggaagagguggccgauuuggucguaaagguguggcgauuaacuuuguuacagaagaggacaagcgcucucuuaaugauauugaacaguucuacaacacccguaucgaagaaaugccuaugaauguugccgaccucauuuaaauuguuacuaauaaaaacagugaaaauuaaaucaaucacacaacacugaggagacacuuuuuggaaauaaagacuuaaauuuccauucugaagcucaacaaacagugguuuuacuuauaauaaaccuuucaacuuccccuccaguuauauuauugaaauguggauauuuuauuuuuuagaauuauucaguuaaauuaauuuucuacuugguuuauauggagcgaauaccguguacagucauuuuuauuuauaaauaaauuuuuaaucuua

SEQ ID NO: 606 - RNA, 970 nt, Halymorpha halys
uuuuaauacuaauguaugaaaaggaauaaauauacaguagccauuaacgaggaaaauggacgcccuuuauucacauggcaguugaacgagccucgugaaguucuuucuuucccguguuccacuauggcucguggcccuaagaagcaucugaagcguuuaaaugcuccaaaaucauggauguuggacaaacuuggugguguuuuugccccaagacccagcucuggcccacacaaacugagggaauccuugcccuuaguuauuuuucuucguaauagacucaaguaugcccuuaccaauacugaagugaccaaaauuguuaugcaaagacugaucaaaauugaugguaaaguaaggacagaccccaacuauccugcugguuucauggaugugaucagcaucgagaaaacuggugaauuuuuucgauuaaucuaugauguuaaagggcgcuacgcuauucacaggauuacuggugaugaagccaaguauaagcuuugcaaaguuaaaagagugcaaacuggaccuaaggguauuccuuacuuagugacacacgaugccaggacuauaagguacccagauccacuugucaaaguucaugauaccauucagcucgauauugcuacuggcaaaauaauugauaucauccgaauggagucaggcaaccuuugcaugauuacuggaggucguaacuugggaagaguagguacuguuguaaacagagaaagacaucccggaucuuuugauauuguucauaucaaggaugcuaguggacacacuuuugccacacgauugaauaacguuuucaucauuggaaaggguagcaaagcuuauguuucauugccuaaggguaagggugugaaacucaguauugcugaagagagggauaagaggcuugcggcaaagggugcauccagcuaaaaagcaugaaguuguaauaauauuuuuaaaaaauauaaaaguuuugaaaaaugua

SEQ ID NO: 607 - RNA, 2548 nt, Halymorpha halys
gcugcauaaccugcgacucaacucaggaggcuuuauuauuucgucuugcuacucaucguuaguguuggacauuucauugaccuuuucuuguguuuugagucguuuguuaauacuuauaaauggcugauuugaaaaguaaugaagauuugucuacugcaauccugaaaaagaaagaucggcccaauagauuaauuguugaagaugcagucaaugaugauaauucuguuguugcccuuucacaggcaaagauggaugaacuucaauuauuucguggagauacugugcagcuuaaagggaaaagaagaaaggaaacuguuugcauaguauuaucugaugauaccugcccugaugaaaaaauuaggaugaacagaguuguuagaaauaaucuaagaguucguuugucagauauuguuucaauucaagcauguccugaaguuaaguauggcaaaagaauacacguuuuaccuauagaugacacuguugagggauugacugggaaucuguuugaaguguuucuuaaaccauauuuucuggaagcauaucguccuauucauaaagaugacacauuuguuguccgaggugguaugcgugcuguagaauuuaaaguaguugaaacagauccugcuccuuauuguauuguagcaccugauacuaucauucauugugaggguacucauaucaagagagaggaagaagaggaagcuuuaaaugcuguuggauaugaugauauuggaggcuguagaaaacaacuggcucagauuaaagaaaugguugaacuuccuuugaggcauccuagcuuauucaaagcaauugguguuaaaccuccucguggaauauuacuuuauggaccaccuggcacugguaaaacauuaauagcacgugcuguggccaacgaaacaggagcauuuuucuuuuuaaucaauggcccagaaauuaugaguaaauuagcuggugaaucugaaaguaaccugcguaaagcauuugaacaagccgaaaaacacgcuccuuccaucauuuuuaucgaugaacuagaugcuauugcuccaaaacgagacaagacccauggagaaguagaacgaagaauugucucacaauugcuuacuuugauggaugggcuuaaacaaaauucucauauuauuguuauggcugcuacaaacaggccuaauucaauugaugcugcucuuagacguuuuggacgauuugaucgugaaauugauauugguauuccagauacuacuggacguuuagaaguucuucgaauucacacaaaaaauaugaaacuggcugaugauguuaauuuagaacagauugcagcugaaacucauggucauguuggugcagauuuagcaucucuuuguucagaagcagcucuucaacagauccgugaaaaaauggaucuaauugauuuagaagaagaccaaaucgaugccgaaguacugaauucucuugcuguuaccauggauaacuucagguaugcuauggguaaaaguaguccuagugcccuucgugaaacagugguugaaguuccuaacauuacuugggaugauauugguggucuagauaauguuaagaaagaguuacaagaauuaguucaguauccaguugaacauccagaaaaguuuuugaaauuuggaaugcaaccuucacgugguguucuauuuuauggaccaccagguugugguaagacuuuguuggccaaagcuauugcaaaugaaugucaggcaaacuuuauuucaguuaaggguccugaauuauuaacuaugugguuuggagaaucugaagcuaauguucgugauauuuuugauaaggcuagagcugcugcaccauguguucuguuuuuugaugagcuggauucaauugcuaaaucaagagguggaaguguuggagaugcuggaggugcagcugauaggguuaucaaccaaauucuuacagaaauggaugguaugggagccaagaaaaaugucuuuauaauuggggcuacuaauagaccagacauaauugauccugcuauucucagaccuggucguuuagaucagcucauuuauauaccauuaccagaugaaaagucaagagaagccaucuucagagcgaacuugagaaaaucgccuguugccaaggauguugaucuacaauauauugccaaaguuacauuugguuauucuggggcugaucuuacugagguaugucaaagagcauguaaacucgccaucagacagucaauugaagcugaaauuaaaaaagaaaaaaguagaucagauggagcuacacgaauggauauggaugaugaagauccugucccugaaauaacccgugaacauuuugaagaggcaaugagguaugcuaggcguucgguaacugauaaugauauucgcaaauaugaaauguuugcucagacauuacaacaaucaagagguuuuggaacuaauuuuagauuuccugcuagcucaaauauuccuagugcgccaggaggugggggaacagaaacuaacaacuuuccugaugauggagaugaugaccuuuauaauuaaaaaaaguuuuuacuagauaa

SEQ ID NO: 608 - RNA, 542 nt, Halymorpha halys
aaacuguaauugggaagccuuggcaacacuggucucaaaccuuuucucuagagcucuguuuaucgcaccacguaaaucccacauuuucaaacaugaccauugaagaugaaucuggcccaucuggcgacuccgucgauaucaacaccgcuuuaaaagaaguucugaaaggaguugugaggaauggaguuauuguacauggucugagggagucagcuaaagcucucgauaagcgacaggcacuacucuguguucuggccgaaaacugugacgagccuauguacaagaaacuuguacaagcucucuguucagaacaucaaauaccauuaguuaaggucgacuccaacaaaaaauuaggggaauggucugguuuauguaaaaucgauaagacaggaaacccaaggaagguugucgggugcucauguguaguuauuaaggacuggggcgaugauacaccucaccuagauguacucaaagauuauaugacagaauccaugugauuguguuuuauauaauuuuuuaauauauaaugugguuuuaaggcg

SEQ ID NO: 609 - RNA, 420 nt, Halymorpha halys
gggcgcagggaucggaaaaaaaaaaaaauaacaguagagaacauaaugucuggacguggcaaagguggcaaggccaagggaaaggcaaagacccgaucaucuagagcaggacuccaguuccccgucggucguauccaucgucuccuuaggaaagguaacuacgccgagagagugggagcaggagccccgguguaucucgcagccguuauggaguaccuggcugcugaaguucucgaguuggccggaaacgcugcucgugauaacaagaagaccaggauuaucccccgucaucuacagcuugccauaaggaacgacgaggaauugaacaagcugcugucgggagucaccaucgcucaaggcggaguacuucccaacauacaggccguucuccuaccgaagaagacagagaagagcucuuaa

SEQ ID NO: 610 - RNA, 5013 nt, Halymorpha halys
cgucuuccguuccuguccuuguuagcugagcuuguccucggcaacucaggauguaaagucccguuucugcuacaucaacuugacuuuuuuuuuucaacacucgagauggauuucagagcugucaucuucauauuagucgcugucgcagcgcuuccaggcuacgcucaagaaaaugggaccaacuugcuuccacgaacaaaaagaaauccuacaaagcuucgucauucacgacguuuugccgaaagaaugcccaccucuuccuacuaugaugacuacccaccugcuaccaguagccagagucaggaaaaccauaaaccaaucuucaccaacuguucaauguaucaaccuucaguuccagaagagcuaacacauacuaccaccguuauacaggugacugcggcugacaaagauccgccagaaucuggagggaaaguaaccuauacuuuuguugcaaccccacaagaaagucaaaaauuuaauauugauccugaaacugggguuauuacuacuagacauagcuuugauagagaugagccaaaccgagaaaaagaaguuuauuuaacaguucgagcgaccgacaauggaaggccucaacuugaugauguuuguacauucaagguuauuauugaagauauuaaugacaacccuccaguauuugauaaaguugacuaccaagaaucuguaccucaagauuuaccaccuaaacgugaaguaaugagaauaucugcuacugauguugaugauggaaacaacaguauuguuauguacagcuuagaaccaagaucugcugauauuuauaacaagaccuauuuucaaauugacaguaaaacaggugugaucacccuugaucgagugauagaucgugauccuggauauaaauuuaaacuuagagcuacagcuacagaucauggugauauccccaagucagcuguuauuaaccuugauauucaaguaguggagucuaauaagaaagcuccagucuucaugucuauaccagccucaccuauuguucuucuggaaaauuucacugauuucacagaaaauauugcaaccuuaacagccauguccaaugaugaaaaagcuccuguuuuugaauuagucacgggaagaacugagcaaaccaauaaauacaguacguuucgguuagaguccgaugcgaauacugcccacauaaggcuugccaggcggauggauuaugaaucuauagcugaauauacauugaccauucgaauucagaacaaauacaauuuggcuucagaaacuaguaucaauauacaguuagaggaugucaaugauaauauuccugccuuuacugaagugguaucugguguuguacuagaaaaugaacccgcuggaacuccagucaugcaaguuagggcuauugaugcugacaguaccacugcucauaaccaggucacauacgaauuggcugauaauacugaaaauuuugcuauugaucgauauacugguaacauuacuacaaaaaagauguuugauagagaagaacaagauuuuuauaauguuaaaguuauagcuacagauaauucuccuucugcuuuauacaaaacuggagucccuaaugaaggucaacagguguuucgaauugaaauagcugauaagaaugaucacccuccaaaauuuacugaagcaguauauauugcugaagccaucccugagaaugcuaauacaaaugcucguguuacccaaguuaaugcucaagacaaugauacugcuucacucguacauuauaguauauuuuauggaaaugaaaaugaugcauuuguaauugaugaaacaacuggugaaauccgugucaauaaaaauuuagauuaugaaaccaggaccaauuauacuuugaaaguuaaagcauuugauggagcuuaugaagacaauugugaggugcauauaaaaauugaaaacgucaaugauaauccuccaguuuuuguuucuuaccaaaaaacuauaacuauaauggaagaagaauuauucccaggauguauugcucagcuugaagcuuaugauccagauauuccagacagaagugcaccucagcauauacuuuauuuuguuguaaaagaagagcaaaggaugugguuaaauaucaacaaaaaagguugccuuucacugauaaagccuuuagauagagauccuccuaaugguacagagucuuggcaaguuuugauuggagccaaagaugaagauggugggccuacugguguacagcagaccacagagaucacaauuacauuaacggacauaaaugacaaugccccauauuuagagaugccccaaccaguuauuuggacagaaaaugaaccuccuggugauauuguaaaauuaaaugcugaagauaaugacgggccagaaaauggucgaccuuuuacuuucaauauugcuccuucugcuaccacugaaauccagaccaaauuuacuauuucagguucaacauuaaaaucacuugucagauuugaccgugaagaaaggaaaucuuauuuuguacccauugcuauuacugauagugguaacccuaguuugacaggaacaaguacauuacauguagucaucggugauguuaaugacaauccaaugaaaaguggauauagugaaauuuuuguuuacaauuacaagggagaggcuccugauacugaaaucgguagaguauauguagaagacccagaugauugggauuuaccugauaaacguuuugaaugggcugguauggcuaguccauacuuuuauuuagauccaaagacagggaugauuaccaugucacaaggaacuauagaucagucauauauucuuaacuuuaccguuuuugaaaauaccaccagguauuuuagugcccacaguguaacugcuacuguaaauguuacugucaaagaaauaccagaagaagcaguugauaagucagguucuguucgucuaguugggauuacugcugaagaauucauagaaucugauucuaauggugucaguaaacgcacaauguucagaaaauauuuagcgaaauuuuuaaauauuacugaagaaaauguugauguuuuuacuguuuuacacucuccucacaauacaaauacaaguuuacuggacguucgauuuucagcucauggaucucccuauuauaguccagaaaaguuaaaugcagcagugagugugcauaaugcugaguuagagaaagagcuaggaguuguaauucuaauggugaacauugaugagugccuuguugaaagacaguacugugaagguucaugcaucaauuuucugaauaaaagccgugaaccgauugcaguuuacacuaauacaacaacuuuuguugguguaaaagcaguuguagacccuuuuuguaacugugaaguacuuucaaggccagucuguuauaauggugguacacuuguuggcaaugacaagugugaaugugaaccuggcuuugaaggaccacauugugaaauuuuaaguguuggauucagugguaauggaugggcucuuuacccucccuuagaaucgugugccgauucacaucugucuuuagaacuucguuccaauaaaaaagaugggcuuguguuuuaucuggggccuacuaagccaaaucgacuguugaaugugcaagauuuuaucucccuugaagugguagauggcuacccaguucuucuauuggauuuugguacugggacuguaaaacuugauccuaaacaaauuagacuugaugauggagagcagcaucgcauugauauaauaugguccagaacaacuauugaauuacaaguugauaauugcaagcuaccuucauguuuaagucuaaaauuaaaagcuggugacaaugaauuuuuaaauguaaauggaccauuacaaguaggagguucauuuguugauuucaauuaccuugacaaccacaugaacuggacucacaagccuucaagagugggauucaguggcuguguuaaaaauuuuaccuucaauaauaaauuguauaaucuugggaugccuggauauucaaaaaaugcugacauugguuguaaugcugguguagcaguugcaguaucuuuuggaauagauccuaguuuuauaauugcaauuauuauuugccuagcuauauuacuaauacuguuguuggcgguuguuguccaucguagaaaaacugaugaccuguauaaagacacugaugauauuagagaaaauaucaucaauuacgaagaugaaggugguggcgaaggagauaugacagccuaugacuuaaaugucuuaaggcucauguauaaugaugcuauacaggacaaaccucugccagaucauuugaauucaaggccagaugaaguuccugauauaugugguuuucuggauggaaaaaaacagucuguugauaaugacccagaaacuaauccuuuugaugauguuagacauuaugcuuaugaaggugauggaaauacuacagguucuuugucaucauuagcuucaggaacugaugaaggugauuugaauuuugauuauuuaucuaauuuugggccacguuuccggaagcuugcugauauauaugggaaagauucuagugaugacgaugaugaugaugauaauuaucaaaccacugcaucugaaagcugguguuaaauucccuuuaguuucaaaaugaauuaauguuugugaaaaauauauccauuuccaguuuguuguuucauaugcuaauaguguacaauauaagcacaagauauuucuuucugugugccauuuacugagucaauuuuaagacaaacuauguauauuguuguaaacagugugcuauuuuguguaauuagacugauauauauauauuuauauacuugauugaugauagcgcuucaauaaauuacuagauguuaaaugucuauuacauauguauauugaauggacuauuuuuauauuuuauguuuuggacauuuucuuuggaugaugauucaggaaaaccccugagaaaagaaaaauaucugucucauuuuuuuuuuuaaauuuacaaaguaaauaaauuuaauccccaauaauaaa

SEQ ID NO: 611 - RNA, 1618 nt, Halymorpha halys
uggggccgcgccgcugaagaaccgccagaguugaaccggugacaaucggcucuacauuccaucgguuagucacgccuuuagcucuccccuugcucaauaacugccaacaugucugacgaggaguauucggaguccgaagaggagacuguaccagagcccgagccucaaaagaagacugagcguagacaaucugaaaagggcgauggugauccagaauuuguaaaacgccaggaggcuaaaacaucagcuuuggacgaacaacucaaggacuacauagcagaauggagaaaacaaagagcgaaagaggaagaggaccugaaacgccucaaagaaaagcaagccaaaagaaagguuaugagagcugaagaagaaaagagacucgcugaaaagaaaaagcaagaggaagaaaggcgagucagagaagcugaggaaaagaaacagagagauauugaggaaaagaggcguagacuugaggaagcagaaaaaaaacgacaggcaaugauggcagcucuuaaggaucaaaguaaaagcaagggcccaaacuucacaaucagcaaaaaggaagcuggucugaacuugucuucagcacaaauugaaaggaacaaaacaaaggaacaauuagaagaagaaaaacguaucucccuuagcauaaggauuaaaccauuaaauauugaaaaucuaaacauugacagauuacgauuaaaagcuauugaacuaugggauugcauuguuaaacuggaaacugaaaaguaugaucuugaggagaggcaaaaacgucaagauuaugaucuuaaggaacugaaggagagacaaaagcagcaacuuaggcacaaagcacugaagaaagguuuagacccagaggcuuugacuggcaaauauccacccaaaauucagguugcaucuaaauaugaacguagaguugauacaaggucauaugaugacaagaaaaaacuuuuugagggcgguugggaaaccuugacugcugaagaauuagaaaaaauauggaagucuagauaugaacaauuuacuaagcgaaaacaugcuaaauugccuaaaugguuuggugagagaccuggcaaaaagaaggaugcuccugaaagccccgaagaggaagaggugaaaccaaccgaugaugauguagaaccagucuaugcagaagaagaagaggcagaggaagaggccgaggaagaggaggaggaagaagaagaggcugaggaagaagaagaggaggaagaagaggaagaagaggaagaagaagaauaaaaaauucagguuauuucuguacauuuauuucuaaugaauaacaaaaucauuauucauugccguugaaugggauauuuuauuccaaauaccagcacaugaaggauuauaagccuuaauuucacaugaauguaaaaggaaaaagcauuugaugcucagaucucagaaacuguaauaagaauugaugagacauuaaauuauguguucaaguguguggauuuuaaauccauaucuacgcacauaacacaaacacauauacaaaagguuuuuguuuacauuuaaaaguauaaauuacagacacaaguauaaaugucauuacccaauucauauaauaaauauauaucucaacacuaaaaua

SEQ ID NO: 612 - RNA, 973 nt, Halymorpha halys
aaggagaaguaagcggacaccagucucaucgccagcuccucucgaaucugugcgaccggcgucaacccagcuucauuuaccaccugugaaaacaaaaaaccuccacaauggacgcgaucaagaagaagaugcaagcuaugaagcuugagaaggacaacgcaauggaucgcgcccuccugugcgagcagcaggccagggaugccaaccucagggccgagaaggcugaagaggaggccagguccuugcagaagaagauccaagccauugagaacgaccuggaccagacgcaggagcaacugaugcaggucuugcagaagcuugaggagaaggacaaggcucuccaaaacgcugagagugaggucgccgcccucaacagacguauccaacuguuggaggaggaccucgaaagaucugaggaaagauuggccacagcaacagcuaaguuggccgaagccucccaagcagcagaugaguccgaaaggcagagaaagguucuugagaaccgcagcuuggcugaugaagagcguauggaugcacuugagaaucagcugaaagaagccagauuucuggcugaagaagcugauaagaaauaugaugaggucgcucguaaauuggcuaugguugaggcugauuuggaaagagcagaagaaagagccgagaguggugaaucuaaaauuguugagcuugaagaagaacuucgcguaguugguaauaacuugaaaucacuggaagugucagaagaaaaggcaaaccagagagaagaagaauacaagaaccaaauuaagacccuuacaaacagacuuaaggaggcugaagcucgugcugaauuugcugaacguuccguucagaaauugcagaaggagguggacaggcuggaggacgaacuuguccacgaaaaggagaaguacaaauacaucugcgacgaccucgaccagaccuucucagaacucguugguuaaauuuauuuucaugu

SEQ ID NO: 613 - RNA, 881 nt, Halymorpha halys
aaauucucuaguuggucuuucgagucgugacguuuguaagugauugucuaacauggcuguugguaaaaauaagggucuuucgaagggaggaaagaagggaguuaaaaagaagguaguugacccuuucacaaggaaagauugguaugaugucaaggccccuucuauguucaauacccggcaaaucgggaagacucuuguuaacagaacccaaggaacuaaaauugcuuccgaaggacucaaaggucgaguuuuugaaguaagcuuagcugaucuucagaacgauacugaugcugaaagaucauucaggaaauuccgccucaucgccgaagauguucaaggcagaaauguuuugaccaauuuucaugguauggauuugaccacagacaaacugaggagcauggugaaaaaguggcagacucugauugaagccaauguggauguacgcacaacugacggcuaucuauuacgaguguuuugcauugguuuuaccaauaaggaccagaugucccagcguaaaacuuguuaugcccaacauaaucaagucagagccauuaggaaaaagauggucgauaacauaacuaauaacauuagcaacagcgauuuaaggauugucguaaacaaacugaucccagauucaauagcaaaagacauagaaaaaauaugucaaggcaucuauccccuccaugaugucuacauuaggaagguuaaaguacugaagaaaccaagguucgaguuaagcaaacuucucgaacuucauggagaugggaaagguucugaugaaccuggcucaaaaguuucgaggccugaggcuuaugagccuccaguucaggagucaguuuaacuuuuauuaauuguuuuguuaauaaaaguguaaaaauguu

SEQ ID NO: 614 - RNA, 806 nt, Halymorpha halys
cacuuuauaguggcgguauuagagauuccuaaucuaguuggucgagaacgcagaaggacgaguaguucuuucgguugcugguuggucuugugaaaaugggaagaagaccagcucgguguuaucgcuacugcaaaaacaaaccuuacccaaagucaagguuuugucguggugugccagauccuaagaucaggauuuuugaucuuggaaagaaaaaggcucguguagaugauuuuccauuguguguacaucuuguuucugaugaauaugaacaacuuucaucagaagcccuugaagcaggacguaucugcgccaacaaauauuuagugaaaaauuguggaaaagaucaguuccacaucagaaugagauugcauccuuuccaugucaucaggauaaacaaaauguuaucgugugcuggagcugauaggcuccagacugggaugaggggagcuuuuggaaaaccacaggguaccguagcuaggguacacauuggucaacccaucaugagcguccguuccagugacagguauaaggcugcugucauugaagcucucaggagagccaaguucaaguuuccaggaaggcagaagaucuauguuuccaagaaaugggguuucaccaaguaugaccgagagacauuugaggaacuccgagcugauggaaaauuagagaaugaugggugcaaugugaaguacaggagggaucauggcccuuuguccaacuggaaaaaaguucaaguugaacuggcagcugcuaguuaauuucauuuuauaauuuucaaaagaaaauaaauuguuuuaaauugacaa

SEQ ID NO: 615 - RNA, 1042 nt, Halymorpha halys
augagcuauauuuacguuguugaagguuguaaacuucaucauguucacccauugcguucugaaagagcuuacauacaagaaaguacauuaccacuuucaucauaucgugaacgcgaagugaagaaaaggaauggggcggaguuuaaagcauguuuucgugaagguaccuaccauuuccaugcucucagauuguuccuuaagccauuuugugaguggauagaccacgcgguauuucacguuucugauaaaaugacuugugcuacuccuauaucgaagaagaagaaguuuguggcagauggaguuuuccgagcggagcuaaaugaguuccucaccagagaacuugcugaagaagguuacucugguguagagguccgugaaacuccuaguaggacugaaauuauaauaauggcaacccguacgcaaaguguauuaggugaaaaaggccgaagaauaagggaguugacaucuguugugcagaaacgcuucaacuuccaaccacagucuuuagaucuuuaugccgaaaaaguuccaacuagagguuuaugugcuauugcucaagcugaguccuugagguacaaauugauuggaggcuuagcaguccgucgagcuugcuacggaguacuaagauucauaauggaaaacggagccaagggcugugaaguugucguuucagguaaacuuagaggccaaagagcaaaaucaaugaaguuuguugauggccuuaugauucacaguggugacccauguaacgaauacguuaauucagcaacccgucauguuuuauuaagacaaggaguguuaggaauuaaggugaaaauuaugcuucccugggacccuacagggaagaauggaccuaagaauccucuaccugauaauguaugcguaguaaauccaaaagaugaaguuauuccuucugauauaaagaccaugggaauagaacuacauccaccagccauuauuuaaauuggguuuugcaauggaacaauuuuuuuaccuccuucauuguuacaucguaaaacaaauacauuuuuaaaaaacuuaa

SEQ ID NO: 616 - RNA, 499 nt, Halymorpha halys
gggacucguucuaccuucuuguuccaauucguccaguuacgaauagugugcuuguucucacuugagcuaaggccguuggcgacuugcacguuuuuuuuaaauauuaacuaaaaugucuaaggcugaacuugcaugcguguacagcgcacuaauccucgcugaugacgauguugccguaacuggggagaaaauccaaaccauccuuaaggcugccggcguugacauugaacccuacuggccuggccucuuugccaaagcccucgaaggugucaaugucaaggaccucaucaccaacaucagcagugguguagguguuggcgguggcgcaccagcaggagcacccgcagguggugcugcucccgcggcugcugcugccccagccgguggugacaagaagaaagaagagaagaagaaggaagagagugaacccgaaucagaugaugauaugggcuucggucuguucgacuaaaaauguacaaauuccuuuuuuuuuauaugu

SEQ ID NO: 617 - RNA, 912 nt, Halymorpha halys
augcuacugucauaguuucauuggugguaucguggauuagucauuuuacuucuuauccaugguuuuguuaucauugaguauuuaguuaaacuaauauugaaagugcaguccauagacauuaaaaaugaguuuccuuaguaaaguuuuccuaggcaaaaaagaagaaaaagcacccacagcuucggaagcuauacaaaagcuucgcgaaacugaagauauguuaauuaaaaagcaagauuuuuuggaaaagaaaaucgaaucggaauuaauccucgugaagaaaaaugguacaaauaauagaagaguugcaauucaagcacuuaaaagaaagaagagguaugagaaacaguuacaacaaauugaugguaccuuggcuacaaucgaaaugcaaagagaagcuuuagaaggugcuaauacuaauacagccguacuucagacaaugaaauuugcugcugaugcauuaaaaacugcccauaaacacauggauguggaccaaguucaugauaugauggaugaaaucgcugagcaacaagaugucgcuaaagaaauaucggaagcuauuucuaacccuguugcuuuuggaaaugacauugaugaggaggaacuugaaaaggagcuagaagaauuagaacaagaagagcuagacagagaacuucuugggacagguccaacugccgaucaauuaccugauguuccugcuacucagcuuccuacaaaaccaaagccaauugcaucggaagaugaugaagaauuaagacaauuacagcagugggcaacaugagugaaacaucaguauuaauauauuaaaucauauuguugaaauuuauuauguguaacuacuuaucuuuuuuuuuuuuauuuuggcuuuguaacauuuuuaaauaaacucguuaaauaaguuguauuuugcga

SEQ ID NO: 618 - RNA, 583 nt, Halymorpha halys
uggcaacauuguuucuacugaagccuucuucaguacucuuggcuucucacguuucggucguguggauuguuuucuucaauuauuaaucaugggucguaugcacgcuccugguaaggguauaucccaaucagcuuuaccuuaucgaagaagugucccaacuuggcugaaacuaucaccagaagauguuaaagaacaaauuuacaaacuaggaaaaaagggccucaccccaucacaaauaggugucauucucagagauucacaugguguugcccaaguacgcuuugugacuggaaacaagauucuucguaucaugaaggcuaugggauuagcuccugaucuucccgaagaccucuauuuucugauuaagaaagcuguugcuaucaggaagcaccuugaaaggaacaggaaagacaaagacuccaaguuccgucuuaucuuggucgaguccagaauccacaggcuugcucgauacuauaaaaccaaagguggacuuccaccaaacuggaaauaugaguccagcacugcaucugcucuuguugcuuaauuuuauauuuucacaaauaaaugguuuuguaaaaucuua

SEQ ID NO: 619 - RNA, 1431 nt, Halymorpha halys
uguaaucuagugcuccuccauuuacuucggagguaggguacagugaauuuagguguucccuauaguaauuuaauucugacuguccguaacauuaaaucaugauucccccgucuucucggccacaggucacuguguacagugacaaaaaugaaccaacuggugaauuauugacucuaccugcagucuuuaaugcuccaauuagaccagauguugucaauuuuguacaucagaauauagcuaaaaaucauagacaaccuuaugcugucagugcugaagcaggucaucagacuucagcugaaucauggggaacagggcgagcuguggcucguauaccccguguaagggguggugguacccaucguucuggucagggugccuuugguaauauguguagagguggacguauguuugcucccaccagaguauggcgcagauggcaucguaaggugaauguuaaucaaaagagguaugcaaugguuucugccauugcagcuaccggaguuccagcucucgugaugucuaaaggacacaugguaaaugaaguaccagaaauuccacuuguggugacugauaagauucaggaguauaccaaaaccaagcaggccacaauuuucuuacaucguaucaaggcuuggucugauauucagaagguuuacaaaucuaaaagauuucgugcugguaaagguaaaaugcguaauaggagacgcauucagcguagaggaccucucaucauuuaugggcaagaucaaggccuaacucgugcuuuccguaacauuccugguguugaucuuaucaauguuucacgauuaaacuugcucaaguuggcaccugguggucauguggguagguuugugaucuggacccaaucagcuuuugaucaacuuaaugcucucuaugguacauggaagaaaaaauccacuuuaaaaaaggauuacaaccugcccaugcccaagaugguaaauacugauuugucucgacuuuucaagucugaagaaaucaagaguguccuuaaagcuccaaggaagaccauugucaggaggguuaggaaacugaacccauugaggaauacucgagcaaugcugaagcucaacccauuugcugcuguucugaagaggaaggcuguccuugcugacaggaaacuuaagcuugagagggcuauugagagaucaaagaaggaaggaauugagcuuaccccucaucagaagagguauguugcuaugcucgagcgaaggaaagcucagaucaaagcugccaaggcugcuaagcccaagaaggugaagaagccuaaggcugauaaaccugcugcuacugaagcaaagaaagcuacugugacuaaaaagccagcaaaaaaagcaacaacagcuguugcucccaaaccuaccaagaaaugaguuaaauguuaauaaaguugguugaguuugguuuuuaaaa

SEQ ID NO: 620 - RNA, 739 nt, Halymorpha halys
agaauguuaaaucaaucucaaaaucguaaaggcguuggcucuagaagcuccagugcagugcuuuuaggaacccuuccauuuuaagugaaaugacgggguuuucggacaagcccaucuuaauugaugguaaaggccaccuuuugggccgacuuucagcuauuguagcaaaagcugcuuugaauggcaacaggguaguuguuguaaggacugagcaaauaaauauuucaggaaacuucuucaggaguaaacugaaguacuuaucauuuuuaagaaaaagauguaauguuaauccugccagggguccauuucacuuccgagcacccagcaaaauuuuauacagaaccaucagggguauggugccacauaaaauugaaaggggaaaggcugcuuuaaggcguaucaaguuguucgaggguaucccucccccguaugacaagaggaaacgaguaguaguuccuacugccaugagaguguugugccuaaaaccugguagagcuuacugccaucuagguagguugucuucugaaguuggauggaaguacaaggauguugugagggcccuugaaaccaagaggaaggucagggcaguuuuugauauccgcaagaggaauucucuaaagaaacugacuaaacaagccaaggaaaagauguccaaagcaaaugcuaauuauacugcaguuauuaauucuuauggauaucguuaagugugauaugugaauaaauuuuuacuuauacagga

SEQ ID NO: 621 - RNA, 5435 nt, Halymorpha halys
gcucgguggagagaacaucugugacuuagcggcuaucauaccaccguacaccaggccaguaccagugccguguucgggauaguguuguuguuccaguuguuguugugguguugccagcuguguuagccugugaccaguguguugacgaggcuccaaguguguuuccuagucaggccagcucggcccguggggggcccgacgagaaugggccccacuucgaggccggcauguccccucccgggcaucuacaagggguggucgggugugaggucggcgacccacucacauggaauaagaugaguggagcagccaguggaucauccaccaagaaaagaaagaaaccugaaaacaaaccucagucucagauuaacaagugccuuaaugaaaagcgaagacgggagcaggagaacaucuacaucgaggagcuugcugagcuuaucuccgccuccuucacagacaugagcagccucucugucaaaccggacaagugugccauccuacaggagacaguucuucaauuugcugccuuacagaucaagacuauaaagggcggagcagcgacuagcgaugccguccagcaaggagaagucucauccagcaagccgacaauuuuaacuaaugagguuuucgggccgcucuuacucgaggcuuuagagggcuuccuguuuguugugaauccugaaggaaaggucgaguuuuguacugagaauauaacucaguucaucaaauaucgccgugaagagguucugggacaaccaguguauaacauuauccaucacggagaccacgcuagguucucaucuuggcuguuaccuaugaguuggucaaaugauuaccaucccccuaggccuaggacguuuaacugcagguuucucaucaaaccacccccagacacuacuguagaagagaagcagcagagacccuaucuguaugagaacaugcagauauccucaacacagcuuccucaaagcaguggaguugauaaagaugaugaugguagcagugaaucuggaccauguuugauguguguugcuagaagaaucccugcuugugaaaagccugcuggcucuccuauugagcaguuuacuaugaaauuaaauacuucgggagggauuaucaauguagauaauacugguguuucagcuccuuauucccaauauuucagcaaggaucaucucaagaauaggaauuuagaugaacuugugcagaguagugaugugcccaaaguaguagcucauauuaaagaagcgcuguccacaggacaaaguuccucauccauuuacaaacugcaaauuggccaugaaaaauuuguucauguacaaacgaaauucaagcuguucaaaucugcgaaucgccagauggaaaaugacuucuuaauggcuacucauucaauauucggggauaacgaagucaauauggaaauuggauccccugcgggaagcaauagucaguccgguaguggaaacaauaguaaccagcagcagcagcaucaacagcaacagcaacagcaaaguucuucaacaaguggagucggcgguccccuaauugcuagugucaauggugcuaauaacagagaccuaaguaacaccaucacccuuaacaacagcuccgcuuuucauuccgucacucugaacucaaaugaccuugauuuuaacuuugacaucuuccccaguucuucgaccugggaccuuagcagugacgaaagggucugggaaagaccggaaucgcgucagaguuugacuccaguagaaagcccauuauauucaaauccucccgcucaauccccagccacuacaccauuuuccaccccauaugcuuuuucacccauccaggagacaacucaggaagagccuccggaggaagauucuggaaaacuucgaaaaauuuugaugacaaagagaccaucuacggaaucagaugauggcgguggagggauuauugcucaacguaauagacaucaaauauuaaaaauucuacuuaaccaagaggaugaagaaucacagccccaggacucaaaaccaccuaauaauaugcuacucaagcuuuugaacacccaaagugaugacgaugauguugaagcaagagcuggguugaagaaacaaaaugagcuacuccaucagcugcuaaaggaagaggauaacaaccgcgaaaaccagcaaagcggugaugauauccugaaaaguuugggauucagaggagaagggggugaugaaaauagaggggguaggaagcgcccaucgucagaugaaugcgaagaccaaccuggcucaaaaagauccucuucuucacugcuggaugcuguuccuccucccccaaauuccucaaccccuucggcagcaucggguaaaucaaggcuuugggaaaagaaccagaugcuugcgucucuuuuagcaaagcguccgacuacuccagcuucaaucccaccaauaccugcuucugugauuucggccacaccacaggauaaacugcagcgucuuguuaaacauccccaaaccagaaaauaccguuauaauucgggcuaugcuugugauacaguaacuaucacuguuucaacaggcuggucuggggguaguguccaaaccggcgcuggcucaccaggacaaaguagaucagguaggaguccagguuauacuggagcaaauacuugggauucugcuucuucagauccuguccuuuccgacauccuggaucaaguaauagagauaguacccgauguuaauacagaugcaccagugcugaugaauaugaucaacucuauggaaacugagacccagcacccgcaaucagcucaacaacaauucgcaucucagcaugaauuuuugaaugaaaagauggcaauaaaugcuauucaaaagucucugaugcucugugaaucugcuguuaaaagcccuaccuauucaaauacuaugucucaggggucaccucagccacagccacagccucagccccaaccccaaccccagccucagccccagccucagccucagccucagcaaccauuucauccuccuccaauguaucaacagaggcaaagguauccccuucaacaacaacagcagcagcagcaacaacaacaacaacaacaacaacagcagcagcagcaacaacagaucagacaaccauucaacaucucuccgaugauucuagcucagcggaauaagcuucaucaccagcagcaaaugcagcagaagcaaagacugcuccaguugcagcaacaacaacagcuugugauuccgucuaaugcuacagcgccaaaugcugaucccgcccuccauaauauugauagccuuaucaauaauacaguugcuccaaauguaucccuccagguaagaucaaguaguguuccugauucacaacugucuccuguugguaguuacccaggucugggaucuguuccaucaccaggacagagaagggcuuacucaccuguaaacggcgggaugacaaguuucucaagcgcagguggcacaggcccgccugugucagggaguggaccucaggcuaggcucucccccaguucucugcaaggcuaccagcaacagccacaacuaucuccaagacucccucagggccagcaaagcuacgguggcgguagugccacuuggucucagcagaauucucgccuuucccuccaacaacaggaaaauccuguccuuaaugcucaguuaacgagcgguggacgaggauaugccagagcuaauucagcagguuuaccuucugugagaucacuugcaggucagcagcgauucccuaccgcagcugaucagcagagcggugcugcuucauaccaauuuaggcugcagcgccagguaucagcaccuccaccucagcaaucuucacccaacccacaguuaccagguggcacaaggguggguuacggaggcggcuuagguucgccaccacucugccaccacccgccgggagcguaucauccagaccagcaguacuguuaccaaccagaccaagcauaucccccucguuuacuacuccacucccacggugguaauaauggcgucacagaguacguaaggcaagaacugcgugcaaugguuggcgcccgaaccagcggaagcgggcggccucaagucccaggcucacuuccucucccuacaccugcgguugaccucgauucucuaccauaugauaugcaaccucagggaguaaaugacaguccaaagaugugggguggaaugaaugaaaugggcacuaguucaccucaaccaacucaacaacuuuccuccaggaguaccauggaagaagugucgagaucgaaugaccagaaaucaucauuguuacaaaaacuuuugucugaguaauguaaaacaccucacaaauuaagugcauuauuauauuuaauuucauuaggaaauuuuaugaaacaaaaguaaauauguacauaaauuauuauaaauaauaguuauaaauauaauuuuaaaaauuacuuuauaaauauauauauaaagagguuuagaguaaauauauauauuaauauauauauuuuugaaugcggguuaccaagccacuaauauuauugggcucaauguuugaacuauaauuuuauuuuuucuaauuuuuauuuugguugauuuauaugaaaucuuucuugcuguucauauaguuguuaaaagauauauacaagaguauauagccucuauugcuuuauuaucguuggauguauuucucucuuuggcuuugacaaaaaaggauccaggagguuauuguuugcaaaauauuauuucauuaaaugaaaagggcuuucacuuuuuuguuagucuauagacuauagaacucgucuagcugaaaucucacuuuuuuggauucucuaacgaaaacaaagccuccuuugccucuuuuaugccauuuuacauauaaguaaugauauaugauuaaaauguuugauaaaauuuuggauguaauuuuugaaaaauuuuguacaguacaauuauuagcaccaauauuuguccuuguauaguugauugaauguaucuuauuagaaaguggauauauaagaaaaaauguuaagacaaaaaugacuggucaacaggaaccucaaaaugcucaauaagaaauguagauuuauuuauuaaugaacucgucccauaucuuuugccugucaaucuucucuccuuauuguuaugcuaucuaauaguuauagcacucauugcacaacgcucuaccuagagggauaaugcuucaaauacgcuagaguucucuuguaaugagcauuugccuacaauguuccuaaccauuuuaucccuuaauguuucaaaagcuuauagauuacuugauauuuuagaauaacgagagauauguuuugugaauuuugaugaagaccagaugugcuagaaaaaaguaauggcaaugugaauuuaaaaaaaaaaauaaaaaacaaaaaaauauaauaagaaaagguauauguauguauauuuaaauac

SEQ ID NO: 622 - RNA, 545 nt, Halymorpha halys
caguggcaacaacaacguggguuucuuugagguuccucacgauucgucggugcgucggauuaacauuuucauccgaauucaucaauccaaaauggggaagauuaugaaagcugguaaggugguguuggugcugagugguagauaugcuggaagaaaagccauagugcugaaaacuugugaugaaggaacacaagagaaggcauaugggcaugcaauuguugcuggcauugaucguuauccccguaaaguccauaagaggaugaguaaaacaaagauccauaagaggucuaagaucaagccuuuuuugaagguuaugaauuacaaccaccuuaugcccacucguuacacaguauccgagaucgcuccugaccaaaaggugguuacaaaagauuugaaggauccaaugaagaagaagaaaauccguuuccaagucaggguuaaguuugaagaaagguacaagcaaggcaaaagcaagugguuuuucgaaaaauuaagguuuuaauugcuuguuuuuuauuucuuaauaauauauaaauuuuaaaaac

SEQ ID NO: 623 - RNA, 733 nt, Halymorpha halys
uuuucuacuugaauaauaauuuaucucuauguucguaaugcaaucaaguuagcgcuggugccuccgaaguuguucuuucguuaguuggcuacuugaagauauggccgugcaaaacaagaagaagggugcugcugccccugagaagaagaaaucccucaaaaaggaaccuaaggacaaauccaaaaauguuaugaaagaagucagaauccgaaaacucugcuuaaauauuuguguuggagaaucuggugacaggcuuacuagagcugcuaagguguuggaacaguugacugggcagcaaccugucuuuuccaaagcaagguacacuguuaggucuuuuggaauccguaggaaugaaaaaauugcuguucacuguacgguccgaggagcuaaagcagaagaaauuuuggagcgaggauuaaaggucagggaauaugaacuucgaagggauaauuucucugacacaggcaauuuuggauuugguauucaggaacacauugacuugggaaucaaguacgauccaagcauugguaucuaugguuuggacuucuauguuguucuuggccggccagguuucaauguugcucaccggcgaagaaaaacugguguuguugguuuccaacauagguuaacaaaggaagacgcgaugaagugguuccaacagaaguaugauggaaucaucuugccuggcaagaaguaauuuuguacuucauaauaaaccguuuuuauuaauagg

SEQ ID NO: 624 - RNA, 6197 nt, Halymorpha halys
aagggcuguccuauaucuuuuaagcccgcugcagacaggacaaggacagaauggcgucgaaaggaccugcagguaugcaaaagggggcugaugaccccgauccaaccccauaucucuucguaucccuggaacagaagagaaucgaucaaacgaaaccauacgaugccaagaaagcuugcuggguccccgaugaagccgaggguuucgucuugggugaaauccaaggaacuaagggagauaucguuucagucaagcucccaagcauggaaacaaaagacuucaagaaagaucuggucggccaagucaacccacccaaguucgagaaaugcgaggauauguccaacuugaccuaccucaacgacgcuucuguccuguauaaccuuaagcagagauacuaucauaagcuaauuuacacauacuccggucuguuuugcguugcuaucaacccuuacaagagauuccccguauacaccaugaggugcgcuaaguuguacagagguaagaggaggaaugaagucccaccucacaucuuugccaucucugacggugccuacguaaacauguugaccaacaaagaaaaccagucuauguugauuacuggugagucuggugccggaaagacugaaaacacgaagaagguaauugcguacuucgccaccguuggugccagcacaaagaaagaagaagcuucagagaaaaaggguacccuagaagaucaagucguccaaacuaaccccguacuagaagccuucgguaaugccaagacaguccguaacgauaacuccucucguuucgguaaguucauucguauccacuucggaccaucaggaaaacuggccggagcugauauugagaccuaucuacuggagaaggcucgugucaucucccaacaaacuuuggaaagaucuuaccacauuuucuaccagauuaugucuggugccgucaagggaguuaaggaguuaugucugcuguccaacgauauuuaugaauacaacuacgucagccagggaaaaauuacuauugcuggaauugaugacggagaggaaaugcaguugacagaugaagccuucaacgucuuggguuucacccagcaagaaaaggaugacaucuacaagaucacugcugcuguuaugcacauggguugcaugaaguucaagcagaggggucgugaggaacaggcugaagcugauggcuuggaagaagguaucagggucgguaaacuucuggguaucgaaggugaagaacuuuacaagaacuugcugaagcccaggaucaaggucgguaacgaauucgucacccaggguaggaauguaucucaggucacauacucaguuggugccauguccaaggguauguuugaucgucucuucaaauucuuggucaaaaaauguaacgagacccuggacacaaaacagaagaggcagcacuucaucgguguacuggauauugccgguuuugaaauuuucgacuacaacggcuucgagcagcucugcaucaacuucacuaaugagaaguugcaacaguucuucaaucaccacauguucguccuggaacaggaggaauacaagaaggaagguaucaacugggccuucauugauuucggcauggacuugcuugccuguaucgaacugaucgagaagccuauggguauccucucaauccuugaggaagagucuauguuccccaaagccaccgauaagaccuuugaggacaaacugaacaccaaccaucucggcaagucucccaacuuccagaagcccaaaccaccaaaaccagguugccaggccgcucacuucgccaucggucacuacgcugguguuguauccuacaacaucaccggauggcuggagaagaacaaggauccccucaaugacacugucguugaccaguacaagaaggguuccaacaagcucuugugcgaaaucuuugcugaucacccuggacagucagcuccugcuggugcagaugcugguggcaaggguggccguggaaagaagggugguggcuucgccaccguaucuuccuccuacaaggaacaauugaacaacuugaugaccacucugaggagcacacagccccacuuuguccguuguaucauucccaaugaauugaaacagccagguguaaucgacucucaccuggucaugcaccaacugacuuguaacgguguacuugaagguauccguaucugucguaaagguuuccccaacaggauggcuuaccccgacuucaagcuccgauacaagauccuuaacccagcuggcguugagaaauuaaccgacgagaaagccauggcuggagucaucuuagaaucuacaggucucgaccccgacauguacaggcuuggccacaccaagguauucuucagggcugguguccugggucagauggaggaacuucgugaugaaaggcucagcaggaucaucuccuggaugcagucauacauccgugguuaccucugcaggaaggaauucaagaaacuccaagaacagagacucgcccuccagaucguccagaggaacuugagaagguaccucgcuuugagaacauggaacugguggaagaugugguccaaagucaagccucugcucaacguagccaacguagaggaagagaugaggaaacuggaggaguuggucgcucaaacccaagccgcccucgagaaggaagagaaggcaaggaaagagguugaggcccucaaugcuaagcugcuccaggagaagaccgagcucuugaggaaccucgaaggagagaagggcacacuuggaagccuccaagagaggucugccaagcuccaggcccagaaggcugacuuggagucccagcuuauggacacacaagaaagacuccaacaagaagaggacgcaaggaaccaacucuuccaacagaagaagaaacuugaacaagaaaauggcagucucaagaaggacauugaggaccuugagcuuuccgucaccaagagcgaucaagacaaggccagcaaagaacaccaaaucagaaaccucaaugaugagauugcccaccaagacgaacucaucaauaaacuuaacaaagaaaagaagauccagagugaacacaaccagaagacugccgaggaacuccaagccgcugaagacaaaaucaaccaccucaccaaagucaaagcgaaacucgaacagacuuuggaugaacucgaagacucccucgaaagagaaaagaaacuucguggagauguugagaaggccaagaggaagaccgaaggagaccuuaaacuuacccaggaagcuguugccgaccucgaaaggaacaagaaggaacuugaacagaccauccagaggaaggacaaggaaauggcuucccucacugccaagcuugaagacgaacaaggaauugucaacaagacuggcaaacagaucaaggaacuccaggcccgcauugaagaacuugaggaagaaguugaagcugagagacaagcucguggcaaggcugagaaacaacgugccgaccucgcccgcgaacuugaagaacucggcgagagguuggaagaagcugguggugccacuuccgcccaaaucgagcucaacaagaagcgagaagcugagaugagcaaauugaggagggacuuggaagaagccaacauccaacacgaaagcacacucgccaaucuccgcaagaagcacaacgaugccgucagcgaaaugggugaccaaauugaccagcucaacaaacucaagaccaagguugagaaggaaaaaugccaauaccugugugaguugaacgaccuccgugccuccaucgaccacuugaccaacgagaaggcugccacugaaaagauugccaagcagcuucaacaccaacucaacgaaguccaaggaaaacuggaugaauccaacaggucucucaacgacuuugaugcugccaagaagaaguugucaauugagaacucagaucuccucagacaacuugaggaggcugagagccaaguaucucaauugagcaagaucaagaucucccucacuacccaauuggaagacaccaagaggcuugccgacgaagaggcuagggaaagggcuacccuucugggcaaguuccgcaacuuggaacacgaccuggacaaccucagagaacagguugaggaagaaucugaagcuaaggcagacauccagaggcaauuaagcaaggcuaaugcugaggcucaacucuggaggcacaaguacgagagcgaagguguugccagggcugaagaacucgaagaggccaagaggaaacuccaggccaggcucgcugaggcugaggaaacuauugaaucucuuaaccagaaagucauugcucuugagaagaccaagcagaggcucgccaccgaagucgaagaucuucaacuugagguugaccgcgccaaugcuauugccaacgcugccgaaaagaaggcuaaggcuaucgacaaaaucauuggagaauggaaacucaagguugaugaccuugcagcugaacuugaugccagccaaaaggaaugcagaaauuacucgacugagcucuucaggcugaagggagcauaugaggaaggacaagaacaacuugaagcuguccgcagggagaacaagaaucuugcugaugaagucaaggaucuccuugaucaaauuggugaagguggacgcaacauccaugaaauugagaaacagaggaagaggcuugaaguugaaaaggacgaacuccaagcugcucucgaagaagcugaagccgcccuugaacaggaagaaaacaagguucucagggcccaacuugaacucagccaggucaggcaagaaaucgaucgucgcauccaggagaaggaagaagaauuugaaaacaccaggaaaaaucaccaacgugcccucgacucuaugcaagccaguuuggaagcagaagccaaggguaaggcugaggcucuccgcaugaagaagaaacuggaagcagacaucaacgaacuugaaauugcucucgaccaugccaacaaggcuaaugcugaagcucagaaauccaucaagaaauaccaacaacaacuuaaggauguccagaccgcacucgaggaagaacaaagagcuagggaugaugcccgagaacaacuugguauugccgaaaggcgagccaacgcucuuggaaaugaacucgaagaaucuagaacucuccuggaacaggcagaccgcggccgucgccaggcagaacaagaacuuaccgaugcucacgaacagaucaacgaacucgcagcucaagccacaagcgcuucugcugccaagcgcaagcucgaaggagaguugcagacacuccaugccgaccucgacgaacuucucaacgaagccaagaacucagaagagaaggcuaagaaggcuaugguugaugcugcgagguuagcagaugaacucagagccgaacaagaccaugcccaaacccaggagaaacuccgaaaggcccucgagacacaaaucaaagaacuccaagucagacuggacgaagcugaaaacaaugcucucaagggaggcaagaaagccauugccaaguuggaacagagagucagggaacucgaaaacgagcuugacggagaacagaggagacacgccgacgcccagaagaaccuucguaaaucugagcguaggauuaaggagcucagcuuccaaucugaugaagauaggaagaaccacgaacguaugcaggaccuuguagacaaacuccaacagaagaucaagacuuauaagaggcagauugaagaagccgaagaaauugcugccuugaaccucgccaaauuccgcaaagcccaacaggaacuugaagaagcugaggagagagcagaccuugccgaacaggcuguuacuaagcugagaacgaaaacuggcggccgagcuggaucaacugcaagagccaugagcccagugaaucgcaacccgaugaggccccugcuggauggcucagcuuuuccaccacgauuugaccuacaccaggaugacuuuuaaauauuauauaugauagcuacgcaaaacaaacccaaacacaauuauguauuuauuuugaaauauguaauuuaagaauauuguuaauaauuccauagcuaguguccgcuagcaucgaaguaauauucacgauuagcgaacuguaccuuauuucaagaaaaugaaaaaaaaaaaguuuuuauguacaguaagaacauucaaaaacacuaaguaauaaaauauuuauaucgugaauaa

SEQ ID NO: 625 - RNA, 962 nt, Halymorpha halys
gcuugugaguagacgguuuuggggagguucuaaacccaugaauuugugcuuuugaagaacaguuuguuucagaacgguuauuugaaaauuuacaaugaguucaauaggaacuggguaugacuugucagcgucacaguuuucuccagauggaagaguuuuucaaguugaauaugcucagaaagcuauugaaaauaguggaacugucauuggucugcgagguaaagaugguguuguuuuagcuguugagaaauuagucacaucaaaauuauaugaaccgggugccaauaaaagacucuuuacuauugacaaacacauuggaauggcugucgcuggacugauuucagacgcaagggcuguugcagaaguugcuagaacggaagcugccaauuacagaucucaauauaagagcaguauuccucuuaaauacuuaaaugaacgagugucuauguacaugcaugcauauacccucuacagugcuguaaggccauuugggugcagcgugauucucagcacauacacggaagaagaugguccagaaauguauaugauugacccuucaggaguuucauauggguauuuuggcugugcuguugguaaggcgaagcaagcagcaaaaacugaaauagaaaaguuaaaacuuaaggaacugucuugucaggaacuuguaaaggaagcagcacgaauuauuuaccucguccaugaugaguugaaggacaaacaguucgaguuggagaugagcuggauuggaucgcacacaaaugguauaagucagcaagucccucccaauguccaugcggaagcagagaaagaugcuaaagcugcgauggaagaagacuccgauucagaaacggaagauauaugagcaaggaaacauuuuuuaaacaaauaaauacuauugugaugaguguuauuucauauuuuguaauaaacuuauggaaaauacauacuguauuuuugcuuaa

SEQ ID NO: 626 - RNA, 982 nt, Halymorpha halys
auuuauuuggaagauguaucaaccacuguagguuaccuuucuaggcaacauuggccuucaaugugguuguguuguaguguaaaguuggacuucguuaaaaacugaaaguugaaaugguugaaacaucaguuguuaccccugcagcuucugcugcgggcaauaagaaagcagggccaaccaggaagccucagcggaggaauuauaaccuuggcucuggaguuuacagguuuagcagaacucgcauguuccauaagaaagcuuuguggaaauuuauugguaagaaaaccccuaagaacccccggccaaaagcgaaaacuacucuugaaaaaaagauugguggugaaaagaauggagguacucguaccgucuauuuaaagaagaggacuaaaucuuauccuacugccaacaaggugaggaaacauccuagcaaaacauauuucugucaacacaagaggagguuccgugcaucucugaaaccuggugcuguugugauacugcuugcuggguuacauaaagggaaaagggcaguucuuuugaagaacauggcuaguggucuucuccuuguuucuggaccauuuacucuaaauggugucccucucaggagaauacaucccaauuauguuauagccacaucaacacagauugauuugucugguguuaaauugccugagcauaugaaugauagguacuucaagagaguaaaagcuaaaaaggcaaagaagagugauggugaaaucuuugcugccaaaaaagaacuauacaaaccaucugaacagaggaagacagaccagaaggagguagauaaacaaauuuuacaggcuauuaagaaacaugaacacagucuacuucucaggaaguaccugugcacaauguuuggccuucgaagcagucaguauccucacaggaugaaauuuuaauuuguuuucaaucuguuuuauauauaaaucugaaaacuaauuauuuuuauguuaguauaagaggu

SEQ ID NO: 627 - RNA, 941 nt, Halymorpha halys
auaugauaguaaucagcugauaguugucuggcguucaaucuguuguuuuugucaucgagaaagauuuuuaucuuaaagaaugucuacuaaagacaaauuggccauuuucccuucucgaggugcccagacuuugaugaaaggaagacuuguuggugcucaaaaaggucacaguuuguuaaagaaaaaagcagaugcccuacaaauuagguuuaggaugauccucagcaaaauaauugagacaaaaacucugaugggagaagugaugaaagaagcagccuuuucauuagcugaagcaaaguucgcuacuggagauuuuaaccaacaaguuuuacaaaauguucagaaagcucaaauuaaaauaagaacaaagaaggauaauguugcaggugugacacuucccguuuucgagagcuaccaagacggaacagauucuuaugagcuugcuggauuggcuagaggagggcaacaguuggcaaaauugaagaagaacuaucagaaagcgauaaaacuucuuguagagcuugcuucauugcaaacuucuuuuguuacgcuggaugaaguuauuaagcuuaccaauaggaggguuaaugcuauugaacacguuauuauaccaagaauugaacgcacacuucaguacauuauuucugaauuggaugaauuggaaagagaagaauucuauagacuaaaaaagauccaagauaagaagcguauugcucgucaaaaagcugaagcuaagaaagcaguggacgcagccgcagcaacgauggccaacaacauucuugaagaaaacgacgaggaccuccuguuuuagaaaucugggaggaauaauuuuaucacucugcuuguucagcauuccuggauuugaaccauuuuuaaaccuuccuauaaaaaacccaccugugaauaguucauguccuuuaaaaucuucuguccaaaacguu

SEQ ID NO: 628 - RNA, 835 nt, Halymorpha halys
ucacucugccaucuauguagucuuuagcuucgccacauugcuuaggacggcgcgguucuccguuggauuuaguaguuuguuccuugaauuaaauaucuuguccuaacagaguauuuauaaacauaaacgaaaaaaauggcuccgaaaggaaauaacaugauucccaauggucacuuccauaaagauuggcaaagguuuauuaaaaccugguuuaaucaaccugcucgcaaauaucgccgaagaauaaagagggucaagaaagcaagggcccuggcuccuaggccagcagcuuuauugcguccugcugucagaugcccaacuguccgguaccauacaaaauugagagcuggcagaggcuucacauuggaagaaauuaagaggguugguuuaugccccggguucgcaagaucuauugguaucgcaguugaucacaggagaagaaacaagucuguagagucuuugcaauuaaauguacaacgucuuaaagaguaucaagcuaaacugauccuauucccaacuaagaagaguaagaaguugaagaagggagaggcuucggaggaagaacaggcuuuagcuacucagguuucuucuccuguaaugccgauuaagcagacuguuaucaagaugaaagccaggaccaucacuccugaggacaaaaacuucucugccuauggagcuuugagaaaggcaagggcagaugugagacuuguuggaaucagagcuaaaaggcugaaggaagcagcugauaauccugaaacuguugagaaggcugcaaaaacgaaaaaaguuaaagcaaaauaaauauuguaaauaaauuuuuuugauuuauucuuuu

SEQ ID NO: 629 - RNA, 656 nt, Halymorpha halys
auuuguuaccucuguguucagcgauaauuuguuuauguuugcagcagguuacaauacuucuucuacacgucauuuuuugaaguuuagaaauggauggguuauuauuagaaccuacucucuauacuguuaaggggaugguaauuuuggacaaugauggacacagaauauuagcaaaauauuaugauccaaguguauuuccaacuucaaaggaacaaaaaggauuugaaaaaaauuuguucaacaagacccaucgagcgaaugcagaaauaauuauguuggauggucuuacaugugucuauaaaucaaauguugauuuauuuuuuuauguuaugggaaguucacaugaaaacgaguuaauauuaaugaguguacugcagugccuuuaugauuccauaagccaaauauugaggaaaaauguagaaaagcgaacacuguuggaaaauuuagaaaucguaauguuagcaauggaugaaauuugugauggaggaauaauauuagaggcagauccaacuagcgucguacaaggaguagcuuuaaggacagaugacaucccacuuggugaacaaacuguugcccagguucuccagagugcaaaagagcaaauuaaaucugcaauauugaagugaauuuaacuuaaaauguuuuaugggaauuuu

SEQ ID NO: 630 - RNA, 1176 nt, Halymorpha halys
agcucuuuacguggcaagaaccacgaaccuuuuccccuacacaccguccgccaucuuagucuucacauauauugggacguguugaucuauuacauuauuuaguguugaauaaguuuaucucaguuguauaaagugucacacaaauccuuccaggauggggaauauguuugcaaauuuguucaaaggccuguuuggcaaaaaagaaaugagaauauugaugguuggucuugaugcagcuggaaaaacuacuauuuuauauaaauuaaaauuaggagaaaucguaaccacaaucccaacuauuggauuuaauguugaaacuguugaauacaaaaauauaaguuucacaguaugggauguugguggucaagacaaaauucgacccuuguggcggcauuauuuucaaaauacucaggggcucauuuuuguuguagacaguaaugauagagaacguauuggugaagcgagagaagaacugaugcgaaugcuagcagaggaugaauuaagagaugcaguucugcucauuuuugcaaacaagcaggaucugcccaaugcuaugaaugcagcugagauaacagacaagcucggccuacacucauugcgcaaucgcaacugguacauucaagcaacaugugcgaccucaggugauggucuuuaugaaggccuugauugguugucgaaccaacugaagaaugccaaccgcuagccugccccucccuuccccgacgcgcucucaucucagggguccuaagugcucucugcacucuagcugccccuuaucucaucuuuaucaccaacacaacucaacauuuuuuaguuuauguaucgcuggcgacaguuuaaaaaggcagcugauugaagaaauacaguaccaaauguucaucgucauuauuauuaauauuuaauaaauaaaaauuauaaugaauggaaaaaaaauuaaauuugugcgggagugaaaagugcgcgcaagguuuaccccaagucugucuuuaauuuuuuuucuuuuugucccuugaguuucugguauuuggauaaugauuaaaaaaaaaaacaaaaaaagaaaaaaauuauauguauagacauuacauuccguauccuaaaaugucucccuuuuaauuauauuuuauauauacgaauguuuuugaaaucuuucaaauauauugcgcuugagugacugua

SEQ ID NO: 631 - RNA, 600 nt, Halymorpha halys
uugagcgacgcagucauucagcuccaguuugccgguuguuguuuaucgaagcucuguguucgggcuuuaaagcuagacaagguuuuaauuccaguucuuccucucaauuuuuauuauuaauaccuuccuccgugaagugaauucauucgccgagagguauuuauugcuagcaauuuucagaaugacugacgaaguuaaucccaaagccuacccguuggccgaugcuacccucacugcuaagauauugaauguugugcagcaagcucucaacuacaagcaguuaaggaaaggugccaaugaaucuacaaaaacuuuaaaucgaggauuagcugaguuuauagugauggcugcagaugcagaaccacuugaaaucuuauugcauuuaccucuauuaugugaagacaaaaaugugccauauguuuuuguccguuccaagcaagcccuugggagagcauguggaguuucacgaccugucgucgcuuguucagugacagucaacgaaggaucucagcugaagccacagauuacaaaaauacaacaagacauagagagacucuuaguguaaauaaauaauuuguuuuuguuuuuuaaauacuauau

SEQ ID NO: 632 - RNA, 1362 nt, Halymorpha halys
augccugauuaucuuggugaugauaugagaaaaacaaaagaugagauggaaggagaagaaaaggauaucaaaucucuugaugaagcugauaucgcuuuacuuaaaacuuauggacagggccaauacacgaaaaguaucaaaagugucgaagaugacauucaaaccauaaucaagcgugucaaugaacugacagguauaaaggagucagauacugguuuagcuccuccagcuuuaugggacuuagcugcggacaaacaaauacuccaaaaugaacagccacuucaggucgccagauguacaaaaauuauuaaugcugauucugaggacccgaaauacauaauaaaugucaagcaauuugcaaaauuugugguugauuuagcugauuccgucgcaccuacagauauugaagaaggaaugcgugugggcgucgauagaaacaaauaucaaauucaaauaccucuuccaccuaaaauagauccaacuguaacaaugaugcaaguugaagaaaaaccugaugucacuuacagugauguuggugguuguaaugaacaaauugaaaaguugagagaaguuguugagacgccauuauuacagcccgaaaaguuugugaauuuaggaauugagccaccaaaaggaguucuucuuuuugggccuccugguacaggaaaaacacuuugcgcaagagcaguugcuaauagaacugaugccuguuuuaucagagucauugggucagaacuuguccaaaaauauguuggagagggagcaaggauggugcgugaacucuuugaaauggccagaaguaaaaaggcuugccucauuuucuuugaugaaauagaugcuaucgguggagccagauuugaugauggagcaggcggcgauaacgagguucaaagaacuauguuagaacuuauuaaucagcuugauggauuugaucccagggguaacauuaagguuuugauggcaacaaauagaccugauaccuuagacccugcuuugaugaggccuggaaggcuggacagaaagguggaguuuggacugcccgaucucgaaggucguucucauauuuucaagauucaugcacguucgaugaguguugagagagauauucgauuugaguuacuugcuaggcucuguccaaacaguacaggagcugaaaucagaucuguuuguacugaggcuggaauguucgcuauucgagcucgaaggaaaguugcuacagaaaaagauuuccuugaagcagugaauaaagucauuaaaucuuaugcuaaguucucagcuacaccaagauauaugacauauaauuaaauuaagcuagcuccagguuaacugauuucauuaaauuauguuacuuuuuuuaaaaaa

SEQ ID NO: 633 - RNA, 638 nt, Halymorpha halys
acacuggacauaaccuuuuaccacgcugucagcuuuagcuucagcucuucucacgugguguucggguuuguagauugucgauuuauuauucgcaaucaugaaaaugaacaaguuagugaccucuucaaggaggaaaaaucguaaacgucauuuuacagcaccaucucacaucagaaggaaauugaugucugcgccucucuccaaggaacucagacaaaaguauaauguucguaccaugccugucagaaaagaugaugaaguucaaguuguuaggggacauuacaaaggacaacagguaggcaaaguuauucaggucuacaggaaaaaguuuguuauauauaucgaaagaauucaaagagaaaaagcuaacggugcaaguguguauguuggcauccauccuuccaaaacagucauugugaaauuaaaaauugauaaagauaggaaagaaauuuuggauagaagaucaagaggaagagcucuagcccuuggaaaggacaaaggaaaguacacugaugagaacacagcaauggauacaucuuaaaaagguguuacuuugaauuguguaaauacauuuuacauaaauuugaaaacauuuuuucuguguauaccgagaauauuuuuuguaaaaaucuuuuuuu

SEQ ID NO: 634 - RNA, 3894 nt, Halymorpha halys
guaaugcaauacuguuuuacacgucuuggcuaucuuaguguugaaaagagaguagaagauugguuuguguuacucuuagcuuguuaaaugucgaugugaaguaacaaaaguuuacuuaaacucagcuguuuuauauccaagugaaauauuaauugaucaaagauuaaaauauugaaauauaauuugcuauucaagaauggcugugguggaacaaccuuguuauacucugaucaauuuuccaucugauuuagagccucccaaugaaaugcaacuaaaaucugauuuagaaaauggagacacuaaagcuaaaauugaagcuuugaaaaauauuauucauuuaauugcaaauggagaacgucuaccugguuuacuuaugcauauuauacguuuuguguugccaucgcaagaccacaccauuaaaaaacuucuccuuauauuuugggaaaucguuccuaagacuacucuagauggcaaacuucuucaggaaaugauuuuaguuugugaugcuuaccgaaaggacuugcaacauccuaaugaauuugucaggggauccacauugcguuuucuauguaaacuuaaagaaccugaauugcucgaaccuuuaaugccugcuauaagagcuugcuuagagcaucggguaucauauguucgaagaaaugcuguacuugcuauauuuaccauuuauaggaauuuugaauucuuagcaccugaugcaccggaacuuauugcuaauuucuuagauggugagcaagauaugucauguaaaagaaaugcguuuuugaugcuccuacaugcagaccaagaacgugccuuauccuacuuggcuucaugucuugaucaagugacuuccuuuggugauauacuucaauuaguuauaguugaauuaauauauaagguuugccaugcuaacccuucugagcguucacgauuuauacguugcauuuauaauuuacucaauucuaacagcccugcaguacgauaugaagcugcuggaacuuuaauuacccuuuccaaugcuccuacugcaauaaaagcugcugcuucauguuauauugacuugauaauuaaggaaagugauaauaauguuaaauuaauuguccuagaccguuuaauaucuuuaaaagagauuccuacacaugagcggguucuucaagauuuaguuauggauauauuacgugucuuagccagucccgauauggaagugaagaaaaaagcuuuaagccuagcacuggaucucacuacuucacgguguguugaagaaaugguuuugauguuaaaaaaagaaguugcuaaaacucauaacuugacagaacaugaagaugcuggaaaguaucgucaacuucuuguuaggacucuucauuccuguugcaugaaguuuccagauguugcugccucaguaauaccaguauuaauggaauuucuuucagauacaagugaacuagcuucauaugauguucuuauauuuguucgugaagcaauucauaaguuugauucuuuaagggcuuugauaauagagaaauuauuagaagcauuuccaaccauaaaaucuaugaaaguucaucgugcugcucuuuggauauugggugaauauacuacuucaguuacagauauuaaagaagucaugaaacaaauaaaaaaugcccuuggagagaugccacuuguugaugaugaaaugaaaagagcuucuggagagaaaguugaggaaguugaucaucgugaucaaguaaagcuuguuacaucugauggaacauaugcuacacaaucaauauuuaauaccauucuugcuauuaaaaaagaagaucgaccuccucuuagacaauacuugauugauggagacuuuuucauugguguaucuguggcuucuacucuagugaaauuagccuuacgcuauaaagagcuuguucagcaggagaauauuuaucauaaauucuuugcugaguguaugcuuauuauuucauccauaguacgucuggguaaaucuggauauccuucaaaacagcuaagcuaugaugauuaugaacgaauguuacuuugucuaaagguucuuucugaaaacaaugccccuauuguuaaaauuuuuaacacugauugucgcaaugcucuugcuaacauguuaguugcucaacagaaugaggaguauucacuuauaaaggccaaagaaaagucuguccauacuauccaaguugaugauccugucucauuuuuacaauuaucaacuaugcgaucaucugauuuugguucagaaaauguuuuugagcuuagucuaaaucaagcuguuggaggaccaaauacugcugcaaacacagcugaacuuccauuuucagcuaguaaacugaauaaaguaacucagcugacuggauuuucagacccaguuuaugcugaagcauauguucauguuaaccaguaugacauuguacucgauguuuugauuguuaaucaaacaggugauacgcuucaaaacuguacacuugaacucgcaacucuuggugaucugaaacuugucgaaaaaccucaaccuuguguucuagcuccuuaugauuucugcaacauuaaagcaaaugugaaaguugcaucuacugaaaauggaaucauauuuggcaauauuguuuaugauaucaguggugcugcuucugacagaaacguuguuguacuuaaugauauccauauagauaucauggauuauauuguuccugcaacuuguucagauacugaauuucgucagaugugggcugaauuugaaugggaaaacaaagugucuguuaauacuuacuuggucgaucuucaugaauaucuuggccauuuauuaaagaguacuaauaugaaauguuuaacaccagaaaaagcucucugugggcaauguggauuuauggcugcuaauauguaugcccguucaauuuuuggagaagaugcacuggcuaacuuaaguaucgaaaaaccauuuaauaagcccaaugcaccuguuacugggcauauuagaaucagagcuaaaagucaggguauggcauugagcuuaggagauaaaauuaauaugacccagaagaaaccuacuauuauggugcagugaagaauuauaauuuuauuguuaaaaugcauuuuaacauuuuauagacuuuuuuauacuuauuugcuuauaaguaauuggaacuauaaguaaaauguauuacucagaauguuuugaaacagauuuauuuauguuaacaaaauuuacuuuuacuugaauccaauaguuguacugcacuauuuaaugugauuacaugcaaauauauagauuuuuuguauauuuuuaugacuuauuaaauuauugcauuugauguauauuauauauuguugaccuaaauuaagaaagcuuauauaucuuucucaaguuuuuauuuuucauguuauuuuauuuugugauaucucaauuugaaaaugauauaugucuguauggcuaugugugugaguguguaaauauacauggguuuauuauuaauauucaaucaauuauaucuauuauuggaaaauggaaaauuuauauguauguuugugugaguguauauauauucaauugcacaugcauguuuaauauguguguguguguguuuuuucuuuauacaccaacucuuaaacucuuacaucaacuguuuuacaguuacuucuccuucuccaaacucucuacauucaccucccacucccuuaccuuuuagaucccuuccauaugacgccuuucccuuucucacugacaacguacagagcuucuuucuaacaaauauuccuucacuaagccuugaacucaagacucaaaauaaacucucuuaccuuuuugaaaacacuaaagaucuuguuucucuccaauacugcucuaacauuguuuacuuuauuccuugccccuccccuaacuguaauccuucaaua

SEQ ID NO: 635 - RNA, 655 nt, Halymorpha halys
uuggcggaagugcacacgugcugcacauuucucaaacuaaccuuuuugguugaucucugggaguagguuguagaguugggcaaggaaacuuauucgacuauuuuccgaaaugccauuucaacgguuuguggaaacgggaagaauugcauacauugcugaugguccauaccaaggcaaauuaugugcuauuguggauguaauuaaucagaccagggcuuuaguugaugguccugaaucuggaguaccaagaugugguauaagguuaaaucaauuacaucuuaccaaauucaggauucguuucccauucacugcuuccacgcguguuguacgaaaagcuuggaaagauagcaauuuggaugcuaaguggaaagagaguguuugggccaagaaguuggaagccaaaaaaauuagggcaaguaugaaugacuucgauagguuccgacuuaauaaugccaggaggaccaggaguaagauuacuaccaacgccuucuuguugcuuaagaaacaagccaaaaaggccaagaaaacugaggugaaaagugacaagaaagcuaaggauaagaaaccugacgcuaaaaaaggugcugcuaagaaagcagaaaaaaagaaguaaaauguauuuuuaauaaaugaacuuuuguuuuaaaaaauugga

SEQ ID NO: 636 - RNA, 6502 nt, Halymorpha halys
auguggcaaugugugggguugauaccucuaucccuuaucuaaaguaguuccacagaauacaguucugcuugcaaaggcauuuuuauccaguuuauucguguugaguugacucguugauaguucucugacuguacgaaguuaaacucuugccuuuucucaaaacuauuauuaaaagugggcguaagguuauucuuauguguaacugguguagccauguugaauuaaagauugauaauauccaugguguuggagguggaagugauuguuuagcuuuccugaggggucaauaggguaauuuaaagaagauuaaguauuuaguugaagcuauuuuauaauauccaagaugucucaaauauuaccgauacgcuuccaagaacauuuacagcuuuccaguguaggaauuaauccaacuaguguaggcuuuaacacauuaacaauggaaucugauaaguucauuuguguuagagaaaaaguuggagaaacuucucaaguugugauaauagauuuaaaugauacugcuaauccaauaagaagaccuauuucagcagauucagcuaucaugaacccugcuaguaaaguaauagcgcugaagggaaaagcugguccugauggaacaaccacucagaaaacacugcagauauuuaauauugaaaugagaaguaagaugaaagcacauaccaugacugaugaaguaguuuuuuggaaauggauuucucuuaauacacuugcuuuaguuacugaaacaucuguuuaucauuggagcauggaaggcgacucgcaaccagugaaaauguuugauagacauucuagucugaaugguugucaaauuauuaacuacagaacagauccuaagcaaaccuggcuuuuacuuaucggaaucucugcucagcuaaaucguguaguuggggcuaugcaauuauauucaguagagcgcaaaugcucacagcccauugaaggacaugcugcaucauuugcucaguuuaaaauggagggaaacccugauguaucaacuuuguuuugcuuugcuguucguacacuucaaggaggaaagcuucauauaauugagguuggacagccuccuacaggaaaccaaccauucucaaaaaaagcaguggauguauuuuuuccaguagaagcccaaaaugauuuuccaguugcaaugcagguuagcucuaaauaugauguaaucuaucuuauuacaaaguauggauacauucauuuguaugauuuggaaacagcuacauguauuuacaugaaccguauuaguauugauacuauauuuguaaccgcuccucaugaaucaacuggugguaucauaggugugaauagaaaaggccagguguuaucagugaguguugaagaggaccauauaaucccauauaucaauaauauauuacaaaauccugaucuagcauuacgcauggcuguuagaaauaaucuagcuggagcugaagauuuauuuguuaaaaaguucaacaugcuuuuccaaaauggccaauaugcugaggcugcuaaaguggcagcaaaugcacccaagggaauacuuagaacuccgcaaaccauucagcaguuccagcaaauaccaaauccccaaggucaaacauccccucuccuucaguauuuuggaauuuugcuugaucagggucaauuaaauaaauaugaauccuuggaguuaugcagaccuguucuggcucaaggaagaaaacaauuauuagaaaaauggcugaaagaagauaaacuugaaugcucugaagaacuuggagauuuagugaagcaaacagauccaacacuugcucugucaguuuauuuaagagcuaauguuccaaacaagguuauacagugcuuugcugaaacaggacaauuucaaaagauuguuuuauaugcaaaaaaaguaggcuauucaccugacuacauuuuccugcuccgaaaugugaugcguguuaauccagaucaagguguuagcuuugcucaaaugcuuguucaagaugaagaaccacuugcugauauaaaucagauuguugacauacugauggagcaaaauaugguacaacagugcacagcuuuccuuuuggaugcccuuaaaaauaaucgaccuucagaaggcccuuuacaaacuaggcuucuugaaaugaauuugauuucugcuccucagguugcugaugcaauucuugggaaccaaauguuuacacauuaugauagagcccacauugcacagcuuugugagaaggcuggucuacuccagagagcauuagaacauuauacagaucuuuaugauauaaaacgagcuguuguucacacucaucuucuuggcccugauuggcuugugggauacuuugguacccuuucuguugaagauucucuugagugucuaaaagccauguuaacugcaaauauucgacagaauuugaauauauguguucagauugcaacuaaguaccacgaacagcugacaaccaaggcuuuaauagaccuuuuugaaucauucaaaaguuaugagggguuguuuuauuuccuuggcuccauaguuaauuucagucaagaucaggaaguucauuuuaaauacauccaggcagccuguaaaacaggacagauaaaagaaguugaacgaauuugucgugaaucgaauuguuauaauccagaaagagugaaaaauuuuuugaaggaagcaaaguugacagaucaauuaccacuuauuauuguuugugaucgguuugauuuuugucaugauuugguuuuauauuuauacagaaacaauuugcaaaaauauauugaaauuuaugugcaaaagguuaauccaucucgguugccaguuguaauaggaggauuauuagauguugauugcucugaagacauuauuaaaaauuugaugaugguuguaagaggacaguuuucaacugaggagcuuguugcugaaguagaaaagcgaaaucgacugaaacuucugcuuccuugguuggaaacucguguucaugaagguuguguugaaccugcuacucauaacgcucuagcaaagauauauauugauaguaauaacaauccagaacgauucuugagggaaaaucaguauuaugauagcuguguaguaggaaaguacugugaaaaacgggacccacauuuggcguguguagccuaugaaagaggucaaugugauagagagcucauaaauguuuguaaugaaaauucucucuuuaaaucagaagccagguaccugguuagacgcaaagauccugaauuaugggcugaaguucuuaaugaaaacaauccuuacaagagaccauuaaucgaucagguuguccaaaccgcucuuucugaaacucaagauccugaagauauuagugugacugucaaggcuuucaugacugcagauuuaccuaaugaacuuauugaacuucuagaaaagauuguucuugacaauucaauauuuagugaccaucggaaucuucaaaaucuccucauucucacugccauaaaagcagaucggucaagagucauggaauauaucaaccguuuagauaauuaugaugcaccugauauagcgaauauugcuauaaauuaucaguuauaugaagaagcauuugcaauauucaagaaguuugauguaaacacuucugcuauucagguuuuaauugaaaauguaaacaaucucgauagagccuaugaauucgcagaacguuguaaugaaccagcuguguggagucaguuagcuaaagcucaacuacagcauggccuuguaaaagaagcaauugauucauucauaaaagcagaugacccuucugcuuauguugauguaguugaaacagcucacaaaacagaaagcugggaagauuuaguccguuauuuacaaauggcaaggaaaaaggcuagagaaucuuauauugaaagugagcuaauuuaugcuuaugcucgcacuaaccgauuggcagaucuugaagaauuuaucucagguccaaaccaugcugauauucaaaagauuggugauagguguuuugaugacaagauguaugaaccugcuaaacuacuuuauaacaauguuucaaacuuugcuagacuagcuauuacacugguucauuuaaaagaauuucaaggagccguagacagugcaaggaaagcaaacaguacaagaacuuggaaagaaguuuguuuugcuugcguggauagugaagaauucagauuagcucaaaugugugguuugcauauuguuguccaugcugaugaacuagaagaccuaaucaauuauuaucaggaccgaggauauuuugaagagcuuauaaauuuguuggaagcagcacuugguuuagagcgugcucauaugggaauguuuacagaauuagcuauucuuuacuccaaauacaaaccaggaaaaaugagggaacauuuagaauuauucuggucucgaguuaauauuccaaaggucuugagagcugcugaacaagcucauuuaugggcagagcuaguuuuucucuaugauaaauaugaagaguaugauaacgcuguaucugcaaugaugaaccacccuacugaggcuuggagggagggccauuuuaaagacauaauuaccaagguugccaacauugaacuauauuacaaagcuauacaauuuuauuuggauuauaaaccucuccuuuuaaaugauauguuguugguauuggcuccaagaauggaccauacuagagcagugaauuucuuugccaagguuaaccauuugcaauuggucaaaccuuaucuucgcucaguacaaucauuaaauaauaaagcaauaaaugaagcucugaacaaucuucuuaucgaagaggaagacuuucaggguguuagaacaucaauugaugcuuuugauaauuuugauaauauuguauuagcucaaaagcuagaaaagcaugaauugauugaauuuaggaggauagcagcuuaucuguacaaaggaaauaaucgauggaagcaaaguguucaauuaugcaagaaagacagacuuuucaaggaugcuauggaauaugcugcagaaucaaagaauucugaaguugcugaagaacuuuuagcaugguucuuggaaaaaggaaaucaugacuguuuugcugcuuguuuguuccaauguuaugaucuucuucauccugauguuauucuagaacuugcauggcgacauaauaucauggauuuugcuaugccauauauuauucaagugacaagagaauauauuuccaagguugauaaauuggaagagucugaagcaagaagguuagaagaaagagcagaacaagaucauaaaccuaugaugaugccggagccacagcuaauguuaacugcuggcccaggaaugauaggaccagguuuuuccccugcuuauccuaacacuuuuaccacuggcaugccuuaucaagguuauggcauguagguaauaucaaaugugaucaacuucuucguauuaugcaacuaaagugaauggucuaaccuccauccagccuaauggaaacugaaauguauaggaauuaaggaauaaauaagucuauaguugcuauagagguucuuuuuguuuucucaacacaugaucuaauucaaggccucuuauacugugguucugucuucauuaaaaaauaaauuguauaaaguuuaauacugccuucauaagugugcuuuuaauaaauaucaugcgcauauaaacuuuguaaaaaucuauauguauguuaugauauuucuguugauauucauaaaacuuauuuaguccuggaugguaaaguuagcaucaacuuaugauuaguuaacggauagucuauuccguuacuacauauauuuuuuauaguauuuaaugaauuuguuaacuauuuaaguuuauguuaugcauuccauuucuucacacauauacacauacauagacucacauuuacacauaauguguauguguguaauauuguguucuagagaauagaaacacuaacuauuuauugugguauuauauuguuagcuugugugaauauuuguuuuauuaguaaaaugauuuacugcuacauuugaaaaauuguuuauauauuuaaauuaugaauuuaucuaauuuuuguguuucaauguuauguuacuuuuuguauuaguuauuucuugaauaacuauguuauuuagguguauuauuauuaguaccaacaugcaaaauaugcacuauaguucaacauauaaauagaccuuauggaaauauguaaagauugaaaaauauacucuuuauuauuagaaucaaauuguauuuaaaaaaauauauauaaguaauuguuaaugguuauuauaucuuauggauguaaugaguccaaagaggagaaagaucaguuauguagagcaaugcucuggcuucauauccagauauguuuuuguauuauauaaguuuacauugcuuucaauguuuuuguuuucuuuuaaaguauauaaauguugcuggauaugaagguggagucaaaaguugaauuaaauaauuauuuuaauuuuauaauuuaauuuuuuuuaauaaauacacuuuauauuuuguuua

SEQ ID NO: 637 - RNA, 645 nt, Halymorpha halys
ugaugaugaucaaguugguuuuguuuccaugcaaggugcuccaucuuucuuuagugaggugguguucggguucaaguacuucguguaugguucuacuauuggugaaguaagugagaaccgucaguuaugcagauuuucgugaaaacccucacggguaagaccauuacccuugagguugagccuucagauacuauugaaaaugugaaagcuaaaauucaagauaaagaagguauuccuccugaucaacagcguuugauuuucgcuggaaaacaguuagaagauggccgcacacuuucugauuacaauauucagaaggaaucuaccuuacauuuaguguuaaggcucaggggaggugcaaagaaacguaagaagaagaauuacuccacuccaaagaagaucaagcauaagaagaagaaggucaagcuagcugugcuuaaauauuacaagguugaugagaaugguaaaaucagcagguugagaagggagugucccucugagcaguguggugcuggugucuucauggccgccauggaggauaggcauuauuguggaaagugugccuacacccuugucuucaauaagccagaggauaaauaaauguuuuuaauauaaaacuaccguuauuaaaguuuuuaauaaacggcu

SEQ ID NO: 638 - RNA, 747 nt, Halymorpha halys
cgcacucgugcaacgauacguggcuacuuuucuucugcacaagaucguccauuuuacucugaacucuucucucguuaggaccuuucucuccguuaguuuuaugcuguuuuagccaaccaugguuaaucggaggguuccaucagugcauaguaaaaccuaugucacuccaaggcguccuuaugagaaggcucgucuugaucaggaauugagaauuauuggagaguauggguuaaggaauaagcgugaaguauggaggguuaaauauacucuugcuaaaaucaggaaagcugcccgagaacugcuuacucuugacgagaaggauccuaagagauuguuugaagguaaugcgcucuugcguagauuaguaagaauaggaguauuagaugaagcuaaaaugaaacuugauuacguuuugggucuuaaaguugaagauuucuuggaaagaagacuucagacucagguguuuaaacuuggucuugcuaaaucaauucaccaugcuaggguuuugauaagacaaaggcauauuagaguaaggaagcagguuguuaacauccccagcuucauugugagguuagacucacaaaaacacauagauuucucauugaaaucacccuucggugguggccgcccuggacguguaaagaggaagaacuccaggaagggaaccacugcugcagcugcagaggaagaugaagauuaauuguuuaaguuuguuuuccuaaauaaaaaaucuuccuggaaggcaua

SEQ ID NO: 639 - RNA, 2055 nt, Halymorpha halys
ugaagcacaguugggcagguuauuaaacagcguuuguagauugauuucugucagguaaucauggcugguguauuagcuacugagagaacccuuccugguuuuucguuugaaaauuguaaaaggaauuccaucuugcugcagcaaggauuuaaaccacccacugcccagaagacugguacaacaauuguuggaauaauauacagagaugguguuauucuuggagcugauaccagagcuacagaagguagcacgguugcugauaaaaauuguuccaagauucauuuucuugcugacaacaucuauugcuguggugcugguacugcugccgacacagaaaugacaacuaugacaaucaugucgcaacuggaauuacaucgucugaauacuggacgcccugucagaguuucuacagccaaacagcuucuuaaacaguuacucuucagguaucaggggcacauuggagcagcucuuguaguuggugggguugauguuacuggaccucuucuuuauucuauacauccucauggguccucugagugcuugcccuucacaacaaugggcucugggucucuugcugcuaugacaguacuugagucuucauggaaaccugauuugaaugaagaagaagguaaagugauaguccguaaugcuauugcugcugguauauucaaugaucuugguucugggaguaauguggacauuugcaucauccgcaaagguucuguugauuauauccgccccuuugauguugcuaaucucaaaggacagaaacaaaauaauuaucguuuucgucgaggaacuacaggaguucuuucuacuaggauaauuccuuugguuacagaaucagaagaaauaaaaaaaacugaaguggaaucaauggauacaucugcuugauaauuuuuauaauauauuauuguauuacuuuuuuuuuuguuucuuuaucuagaaguugaaaauaaauaauauuucuaaaaucagguguuuaaagguuuuauccauuucuuuguuuuuuaagcaacugaaauauaauuuucuuuccccaaaaucuaugugugauauuuuuauuuauauuccagaauguaaauaauccuaucuaucuggaauaaugagaccaggacuauucaagacagguaucuguaaucuguaaauaacaacuugcuaauauuuguaagguaguguaaaauaacugaggaccugagugggauacuguguuucacucucacaauuugcuuuuccauccaucacgucugagacaacagacaacauuuuucaaaauguuaagacagaccugauaaaauaaaccguaauaugacaaguaauauuggguuguuucauaugaaauuucaguuuucacaggaaagguuuuuuaguaaaacaacuuuuauaaucauaacauuuuuauuuaaauuauuuaaauuauuuauccucauuuucuguacauuuuucccaacuuguuaucaucuuuucaaucccagaacugaauaauucaggguuuuguaaagaaaugaguuuuugaccugauaaucauuuuguccaggucuuucaucgauauuuacccaauggccugacugacaccuguggucauaugcaauccacuuucaucacauaugauuauuauuucgagaaaaggcuuguuuuugcuuaguaagcagugaaaaucauaccuuacugcugcuggccauuaaguuccugaggucugaacggcaugguaauguuucuggcagcuguggcugccgaguguccaaguuuaaacucauaaaaaacauuacucgaaaauuggguaaaccuuguguaaucaauaaauucuuguaaaucgaauaaaaaaagagaggauuauuaauggcucauuaugaucuguaaacaacagaaguccacaaauccuauuuuaaauuucugaauuaauaaaaacagacauuucaaauaaaaugacccaauuguauuucuaauguuuauugauguuaagaauguuuuauuuucuauuuuugucauauuuauucuaaucuaacaucuugcauauggaucauucucucaguagaauuaagcaaaacuugugag

SEQ ID NO: 640 - RNA, 858 nt, Halymorpha halys
aacaaugauaaaaguguagguuauagugacucaggucagguuauuacacuuuugcuugguaaucauggguucugagagauacaguuuuucuuugacuacauuuaguccuucuggaaaauuaguucaaauugaguaugcccuugccgcuguugcagcuggagcuccaucaauugguaucagagcguccaauggaguuguauuggcuacugaaaacaaauacaaaucaauuuuauaugaagagcauacuauucaaaaaguagagaugauaacuaaacacauaggaauggucuacagcggaaugggaccugauuaucggcuacuugucaagagagcgagaaagauggcacaacaauaucagcuaguuuauggcgagccuauuccuaccgcacagcuuguucaacgaguagcuaugguuaugcaggaguacacucagucaggaggugugaggccuuuuggaguuucuuuacucaucuccggcugggauggggauaaaccaucccucuuccagugugauccaucaggagcauacuucgccuggaaagcuaccgcaaugggaaaaaacuuugucacuggcaaaacauucuuagaaaagagguacagugaaacuuuagaguuggaugaugcuguacauacugcaauucuuacucuuaaagaaaacuucgaaggccaaaugacuucagacaauauugaggucgguguuugcgaugcacaaggauucagaguucuggacccgaccacagugaaggauuaucuggccaauauuccauaaguccauuauuaaaguuugauuuuauaauuaauaaaaggugguuucugaagauuuucuauguauaaugccuaauacagucuuauuuuuua

SEQ ID NO: 641 - RNA, 958 nt, Halymorpha halys
auauguauuugaaauuauuucauucauccauaguuggcagcacuagguauuccuucaaugucgacacgcuguaaacguuccuuacuauagaauggcuccugcuaagaaaccagcaccagccucuaagaaggugccgacaaccacuguuacaagugguaaagcuggcaaagcaacugcaacugcuacaaaggcagcuccagcaccagcugccaaagcagcugcagccaagucagcagcccccaguucugcuaagccagcaucagcuaagcaaccugccccagcuccuaaagcggcacagccuaaggcccaagccaagccugcugcucaacaacaaaaauccacuaaaccacaacagcaaacaaaagcugccgcuacagcaaaagcucaagccaagcccgcagcucaggcaaagccugcugcuccggcugcagcuccuaaacaaccggcugcuccagcggcagcuggaacccaaccugccccagcagcacccaagaaagcuccaucaggugccgugaagaaagcaacaacugccccuaagaaaagccagaauuuacagaaaaagucccaucaagguguuagaaaacaaguguuaaaaggaaaaggacaaaaaaagaaaaaagucucauuaaaguuuauaauugacuguacucauccauaugaggacaaaauuauggaugucgccaacuucgaaaaauauauucaggagagguuuaaaguuaaugguaaaaccaacaacuuaggcaauaauguuaccuuagaaaggaacaaaaugaagauuacuguuacuucagauguucauuuccccaagagguacuugaaauauuugacuaagagguaccuuaagaagaacaaucugagggauuggcucaggguaguauccaguucuaaagacacuuaugaacugagguacuuccaguuuaacagccaggaugaugaugaugaagaggacaaugauuaa

SEQ ID NO: 642 - RNA, 532 nt, Halymorpha halys
auaaaaacaaauauaccguaauugccauaagaguuuguaagcuagagagcgacacagugcgcagcuuucauucagaaggcuuugguaggguucuuuagcaagugcuucguguucgggguauaucuguuauaauuuuacaaugaccaagaaaaggaggaauggaggaagaucuaaacacgguagggggcauguacaagcaguccguuguaccaacugugcccguuguguaccaaaggauaaggcuaucaagaaauucguuauccguaauauuguagaagcugcagcugugagagacaucacagaugcuaguguuuacucaucauaccaauugccaaaacucuacgcuaaacugcauuauuguguaucaugugcgauccacucuaaaguaguacguaaucguucuaaggcugagagaagaauuaggacaccuccucagcguaacuucccaagggauaugaugcgucaagguggaccccagauaagaaaauaaucuuuuucaaacuaauguuaauaaaaaccauuuuuaauuauu

SEQ ID NO: 643 - RNA, 1061 nt, Halymorpha halys
uacccaaagccauuacgauccgcaacguguuccugcuggggccgugcuaaguaaguuugguguuaaagggaaauauuucuuuuagcgaucgggcuguuggccguuuagaaugggguucguuaaagucgugaaaaacaaacaauacuauaaaagguuucaaguuaaauuuaagaggcgacaagaaggaaaaacugacuacuaugccaggaaaagguuaauuguacaagauaaaaauaaguauaacacuccaaaauaucgucugauuguucgccucuccaacaaagauauuacuugucagguugcuuauucccgcauugaaggugacaaaauauugugugcugcauacagccaugaacuuccucauuuuggaauuaaaguaggauuaaccaauuaugcugcugcuuacuguacuggucuucuuuuggcuaggagguuacuucagaaauugaaguuagaugcuuuauaugaagguaccacugaugucacuggugaugaguacaauguagagaacuuggacgaagguccaggagcuuuccguugcuacuuagauguugguuuaaugaagaccagugcuggagcccguguuuuuggagcauugaaaggugcuguugauggaggucuuaacaucccucacagcaugaagagauuuccugguuaugauuuugaaagcaaggaguucaaugcugaaguucaccgaaaacauauuuuuggaauucauguugcugacuauaugaggcaguuggccgaaucugaugaagaugcuuacaagaagcaguuuagcaucuacaucaaaaauggcauuguuccugaugcuaucgaagacaucuacaagaaggcgcaugcagcaaucagggagaauccugccccuagaccgaagguaaggaguaaggaagccaucaagaagagauggaaccgugcuaagcuuacccuugcggagaggaagaauuguauugcccaaaagaaagcagcauuuuuaaagaaaaugaaggccggagaaguugaugccuaauuuguuaaauuuguugcuuuuacuuuugauaauauaaaauuccucuuuuaaa

SEQ ID NO: 644 - RNA, 3635 nt, Halymorpha halys
aacaaccaaugaaaugcugccaacaaggaagaaaugacgucaguaaaggaaaaucgaugaacuuauaaaaggaccgcucugcgcugcgcccaauucagucgcaaaguuucugugauaaagaguuguucaaguaucauuggagauugaagaugcagaucuucgucaagacacuuaccggcaaaacaauuacauuagaaguugagccuucugacacaauagaaaauguuaaggccaaaauucaagacaaagaaggaauucccccagaccaacagagauuaauuuuugcuggaaagcagcuugaagauggccgcacacuuucagauuauaauauucagaaagaaucuacauuacauuuggugcuucgucugagaggaggcaugcagaucuuuguuaaaacucuuacuggcaaaacaaucacuuuagaaguugaaccuucugacacaaucgaaaaugucaaggcuaaaauccaagacaaagaaggaauucccccagaccaacagagauuaauuuuugcuggaaagcagcuugaagauggccgcacccuuucagauuauaauauucagaaagaaucaaccuuacauuuaguacuucguuuaagaggaggcaugcagaucuucgucaagacucuaaccgguaaaacaauuacauuagaaguugagccuucagacacaauugaaaauguuaaggccaaaauucaagauaaagaaggaauuccaccagaccaacaaagacugauuuuugcuggcaaacaacuagaagauggccguaccuugucagauuacaauauccagaaggaaucuacucuucaucuggucuuacgucugagagguggaaugcaaauuuuuguuaaaacuuuaacugguaaaacaauuacauuggaaguugagccuucugacacaaucgaaaaugucaaggcuaaaauucaagacaaagaaggaaucccuccagaccaacagagauuaauauuugcuggaaagcagcuugaagauggccguacucuuucagauuacaacauucagaaagaaucuacuuuacauuuaguacuucgucuuagaggaggaaugcagauuuuuguuaaaacucugacuggcaaaacaaucacacuggaaguugaaccuucagauacuauugaaaaugugaaggcaaagauccaagauaaggaagguaucccuccugaucaacagagauugauuuuugcuggaaagcagcuugaagauggacguacucuuucugauuauaacauucaaaaagaaucuacucuucauuuaguccugcguuuacgugguggaaugcaaauauuuguuaaaacucuuaccggcaagacaaucacgcuggaaguugaaccaucugacacuauugaaaaugucaaagcgaaaauucaagauaaagaaggaauacccccugaccagcagcguuuaauuuuugcuggaaaacaacuugaagaugggcgaacccuuucagauuauaauauucaaaaagaguccacucuucaucuuguacugcggcugcgaggugguaugcaaauauuugugaagacuuuaacaggaaagacgauuacauuggaaguggaaccuucugauacaauugaaaauguuaaagcuaaaauucaagauaaggaggguauuccaccagaucagcaacguuugaucuuugcaggaaaacaguuggaagauggucguacucugucugauuauaacauucagaaggaaucaaccuuacauuuaguucuacguuuacgugguggaaugcaaauuuuugucaagacacuaacaggaaaaaccauuacauuagaaguggaaccuucugacacuauugaaaauguuaaagcuaaaauucaggauaaagaaggaauuccgccagaucagcaaaggcugaucuuugcaggaaaacaguuggaagauggacgcacccuuucugauuacaauauucaaaaagaauccacacugcaucuuguacuucgacuucguggagguaugcagaucuuugugaaaacuuuaacuggcaaaacuauaaccuuggaaguugaaccaucugauaccauagaaaauguuaaagcuaaaauucaggauaaagaagguauuccaccugaucagcagagacugauuuucgcugguaaacaacuagaagauggccgcacccucucugauuauaauauccagaaagaaucaaccuuacauuuaguacuucguuuaagaggaggaaugcagaucuucgucaagacucuaacugguaaaacgauuacauuagaaguugagccuucagacaccaucgaaaauguuaaggcuaaaauucaagauaaagaaggaauuccuccugaccagcagcguuugaucuucgcuggaaaacaacucgaagauggccgaacccugucagauuauaauauacaaaaagaguccacucuucaucuuguacugcggcugcgaggugguaugcaaauuuucguuaaaacuuuaaccggcaagaccaucacccuggaaguugaaccuucagauaccauugaaaauguuaaggcuaaaauucaggauaaagaaggaauuccaccugaucaacagagauuaauuuuugcugguaaacaacuagaagauggucguacccucuccgauuauaauauccaaaaagaauccacauuacaucuuguucuucgucugcgagguggcaugcaaauuuuuguuaaaacucucacuggaaagacuaucacuuuggaaguugagccaucugauacuauugagaacguuaaagccaaaauucaggauaaagaaggaauuccaccggaucaacagagauugauuuuugcuggaaagcagcuugaagauggccgaacccuuucagauuacaauauucaaaaggaauccaccuuacaucuuguacuucgucuuagaggagguaugcaaauuuuuguuaaaacucuuaccggcaagacaaucacgcuggaaguugaaccuucagauaccauugaaaaugugaaggcuaaaauucaggauaaagaaggaauuccaccagaucaacaacguuugauuuuugcuggaaaacaacucgaagauggccgaacccuuucugauuacaacauucagaaggaaucuacucuucauuugguccugcguuugagagguggaaugcaaauuuuuguuaaaacuuuaacugggaaaacaauuacauuggaaguugaaccaucagauacuauugaaaacguuaaagcuaaaauucaggauaaggaaggaauuccuccagaucagcagagauugauuuuugcuggcaaacaauuagaagaugggcgcacccucucugauuauaauauccaaaaggaaucaacauugcaucuuguacuucgucugagaggaggaaugcaaauuuuuguuaaaacuuuaaccggaaaaacaaucacacuagaaguagaaccuucugacacuauugaaaauguuaaagcuaaaauucaggauaaagaaggaauuccaccggaucagcagagacuuauuuuugcugggaaacaacuugaagauggccgaaccuugucugauuacaacauccagaaggaaucaacccugcauuuaguuuugcgucuuaggggcggauauuaaggcuauuagcauuucauuccaucaaaauuccauaucaguaaauugcuuuugauauuuuua

SEQ ID NO: 645 - RNA, 1563 nt, Halymorpha halys
gccgacaagaggagccccccaccagucagugagacccuaggauucgcgggugucugugucgagaccuccuucaguaauaucagguuccuguccuuaaaccaaaagcaaaauggcggaugaugaggcgaagaaggcaaaacaggccgagauugagcggaagagagcggagguccgaaagaggauggaggaggccucaagaggcaagaaggccaagaaagguuucaugacgccagacaggaagaagaaacuccgacuucugcugaggaagaaagcugcugaagaacugaagaaagaacaggaaaggaaagcagcugaaaggaggaggaucauugaggagcgcuguggaaaaauaugugauguugacaacgccagugaagcgacccugaagaaaaucugccaagacuaucacaagcggauugaugcuuuggaacgcaguaaaauugacaucgaguuugaaguggagagaagggaacuugagauugcggaucuuaacagccaagucaaugaucuucguggcaaguucguuaaacccaccuugaaaaagguuuccaaguaugaaaauaaauuugccaaacuccagaagaaggcugcugaauucaacuucagaaaucaacucaaaguuguaaagaagaaagaauuuacccuugaagaagaagauaaagagaaaaaaggaggaaucgucgacugguccaagaaggaugaaaaggcaaagguggaaguagaagacgaggaugaagaaucuguaucagaagcgcuaccaagcgccgccgaagagacaauagcuucagaggccagcgagcugccacaagaugaaccaccuccuccacuggaaccagagcccgaaccugaaccucuuccuccgccaccuccaccaaaaacagaggaagauuuguggcuauuccugcgugaggcaguuacccaagcaaauccucuauccauugaugaauugcuucacaaauuacuugauacaguaaacgcaguaccccaagauuucuuagagccuguuguagaagcuucaauuaaaagaucucaaaguaugcagaguauggaucuuucccacgcagaaucucuuccggccgacggugaaccaccaaaggagggugagccuggcgaacaacccccagcaacugaaggaguggcuggcgucccugcugagggagaggccaaaguugaacagggaggagaagggaaugcggcggagaaagcaccacaagcagaaagcccggcugcugaaagugcucccgugcaggaacagcagccugcugaucaaccaccagcacaaucaccaaccgaaccaccagcacaaguaccaaccgaaccaccagcacaaguaccaacugaaccaccagcacaaguaccaaccgaacagccagccgcgccaccggcgggggaacaacccccaccaccacaagcggaacaaccccaaccacaaaucguagaagcugcagcuuaaaaauaaacugaaacgaggaauacaugauuuggaauucuaauauuacuccuugauauuugaagauaacaaagcucuuguaaauuauuuuuauuacaauaaauguuucauaa

SEQ ID NO: 646 - protein, 117 aa, Halymorpha halys
MAPKAPKYEMAVGLKKGHRTTKIVMGKSKADKKHKVRPSRLKGRQTKHTKFVRDLIREVCGHAPYEKRGMELLKISKDKRALKFLKRRIGTHIRAKRKREELSNILTQMRKAHAQQK

SEQ ID NO: 647 - protein, 226 aa, Halymorpha halys
MSLSDADVQKQIKHMMAFIEQEANEKAEEIDQKAEEEFNIEKGRLVQNQRLKIMEYYERKEKQVELQKKIQSSNMLNQARLKALKIREDHVRDVLDDARKRLLQSVKDEARYRDILVKLMLQGLYQLMEAEILVRTREMDGPLVSSVFPDVLVKYKEVSGKDLQLKLDTELYLPSECAGGIELYTARGRIKIANTLESRLDLISAQLLPQIRTSLFGSNVNRKFND

SEQ ID NO: 648 - protein, 118 aa, Halymorpha halys; identical to SEQ ID NO: 327

SEQ ID NO: 649 - protein, 385 aa, Halymorpha halys
MKSEVMRVSHELQAQTEKIKENTEKIKVNKTLPYLVSNVIELLDVDPEETEEDGAVVDLDARRKGKCAVIKTSTRQTYFLPVIGLVDAEKLKPGDLVGVNKDSYLILETLPAEYDARVKAMEVDERPTEQYSDIGGLDKQIQELIEAVVLPMTHKEKFENLGIHPPKGVLLYGPPGTGKTLLARACAAQTKSTFLKLAGPQLVQMFIGDGAKLVRDAFALAKEKSPAIIFIDELDAIGTKRFDSEKAGDREVQRTMLELLNQLDGFSSTADIKVIAATNRVDILDPALLRSGRLDRKIEFPHPNEDARARIMQIHSRKMNISVDVNFEELARSTDDFNGAQCKAVCVEAGMIALRRGAGVVTHEDFMDAILEVQAKKKANLNYYA

SEQ ID NO: 650 - protein, 128 aa, Halymorpha halys; identical to SEQ ID NO: 329

SEQ ID NO: 651 - protein, 395 aa, Halymorpha halys; identical to SEQ ID NO: 330

SEQ ID NO: 652 - protein, 417 aa, Halymorpha halys
MAGAMLFERSVSSRDRDNSRILPTSNRNVDDDNDEEEIKNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVDSPKALVALKYMLLSKIMLNTPEDVQQLVSGKLALKHAGKDIDAMKSVAQASHKRSLADFQLTLKNYKKELEEDPIVRAHLGTLYDNMLEQNLCRIIEPYSRVQVDFISKSIKLPLPQVEKKLSQMILDKKFNGILDQGDGVLIVFEDAIVEKTYEMALEVINSMGKVVDTLYQKAKKLS

SEQ ID NO: 653 - protein, 159 aa, Halymorpha halys; identical to SEQ ID NO: 492

SEQ ID NO: 654 - protein, 200 aa, Halymorpha halys
MSSLKLQKRLAASVMRCGKKKVWLDPNEINEIANTNSRQNIRKLIKDGFIIKKPVAVHSRARVRKNTEARRKGRHCGFGKRKGTANARMPAKVLWVNRMRVLRRLLKKYREAKKIDRQMYHDLYMKAKGNVFKNKRVLMEFIHKKKAEKARSKMLRDQAEARRQKVKEAKKRREERITLKKQEILQSYQREDEAATTAKK

SEQ ID NO: 655 - protein, 204 aa, Halymorpha halys
MGAYKYIQELYRKKQSDAMRYLLRIRVWQYRQMTKMHRVVKPSRPDKARRLGFKNKQGFCIFRIRIKRGGRKRPVPKGATYGKPKSHGVNQLKPTRSLHAMAEEKVGRKCSGLRVLNSYWVAQDARYKYYEVICVDPAHKAIRRDAKANWICDPVHKHREMRGKTSAARKSRGLGKGHRYSQTKGGSRKAAWVRRNTLQLRRKR

SEQ ID NO: 656 - protein, 376 aa, Halymorpha halys; identical to SEQ ID NO: 335

SEQ ID NO: 657 - protein, 376 aa, Halymorpha halys; identical to SEQ ID NO: 336

SEQ ID NO: 658 - protein, 505 aa, Halymorpha halys
MVLIAAAVCTKAGKTIVSRQFVEMTKARIEGLLAAFPKLMSSGKQHTFVETDSVRYVYQPLEKLYMVLITTKASNILEDLETLRLFSRVIPEYCRNMEESEITENAFNLIFAFDEIVALGYRESVNLAQIRTYVEMDSHEEKVYMAVRQSQEREAKNKMREKAKELQRQRLEAGKKGYKTPSIAGFGSSSTFTSPVVETIDLPKPTYTPAKPVLSAKAMKLGGKSRDVESFVDQLKSEGENVISQVAANKPVVAKLASTPNIHMEEVHLKQEEKLMVSVGKDGGIQSFELHGLVTLRITDEKYAKIKVYLDNKDKRGIQLQTHPNVDKELFKLKSQIGLKNPSKPFPLGTDVGVLKWRYQSQDESALPLTINCWPSENGQGGCDVNIEYELEHTHLELNDVTINIPLPIGCSPVVAECDGEYKHESRRNLLQWVLPVIDRSNKSGAMEFSASSSMPSDFFPLTVSFTSKQPYADLKAVEVLHVDDETPVKFSSETLFYTERYEIV

SEQ ID NO: 659 - protein, 422 aa, Halymorpha halys; identical to SEQ ID NO: 338

SEQ ID NO: 660 - protein, 299 aa, Halymorpha halys
MKRNKYTVAINEENGRPLFTWQLNEPREVLSFPCSTMARGPKKHLKRLNAPKSWMLDKLGGVFAPRPSSGPHKLRESLPLVIFLRNRLKYALTNTEVTKIVMQRLIKIDGKVRTDPNYPAGFMDVISIEKTGEFFRLIYDVKGRYAIHRITGDEAKYKLCKVKRVQTGPKGIPYLVTHDARTIRYPDPLVKVHDTIQLDIATGKIIDIIRMESGNLCMITGGRNLGRVGTVVNRERHPGSFDIVHIKDASGHTFATRLNNVFIIGKGSKAYVSLPKGKGVKLSIAEERDKRLAAKGASS

SEQ ID NO: 661 - protein, 802 aa, Halymorpha halys
MADLKSNEDLSTAILKKKDRPNRLIVEDAVNDDNSVVALSQAKMDELQLFRGDTVQLKGKRRKETVCIVLSDDTCPDEKIRMNRVVRNNLRVRLSDIVSIQACPEVKYGKRIHVLPIDDTVEGLTGNLFEVFLKPYFLEAYRPIHKDDTFVVRGGMRAVEFKVVETDPAPYCIVAPDTIIHCEGTHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEDQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKKEKSRSDGATRMDMDDEDPVPEITREHFEEAMRYARRSVTDNDIRKYEMFAQTLQQSRGFGTNFRFPASSNIPSAPGGGGTETNNFPDDGDDDLYN

SEQ ID NO: 662 - protein, 134 aa, Halymorpha halys; identical to SEQ ID NO: 341

SEQ ID NO: 663 - protein, 124 aa, Halymorpha halys; identical to SEQ ID NO: 501

SEQ ID NO: 664 - protein, 1498 aa, Halymorpha halys
MDFRAVIFILVAVAALPGYAQENGTNLLPRTKRNPTKLRHSRRFAERMPTSSYYDDYPPATSSQSQENHKPIFTNCSMYQPSVPEELTHTTTVIQVTAADKDPPESGGKVTYTFVATPQESQKFNIDPETGVITTRHSFDRDEPNREKEVYLTVRATDNGRPQLDDVCTFKVIIEDINDNPPVFDKVDYQESVPQDLPPKREVMRISATDVDDGNNSIVMYSLEPRSADIYNKTYFQIDSKTGVITLDRVIDRDPGYKFKLRATATDHGDIPKSAVINLDIQVVESNKKAPVFMSIPASPIVLLENFTDFTENIATLTAMSNDEKAPVFELVTGRTEQTNKYSTFRLESDANTAHIRLARRMDYESIAEYTLTIRIQNKYNLASETSINIQLEDVNDNIPAFTEVVSGVVLENEPAGTPVMQVRAIDADSTTAHNQVTYELADNTENFAIDRYTGNITTKKMFDREEQDFYNVKVIATDNSPSALYKTGVPNEGQQVFRIEIADKNDHPPKFTEAVYIAEAIPENANTNARVTQVNAQDNDTASLVHYSIFYGNENDAFVIDETTGEIRVNKNLDYETRTNYTLKVKAFDGAYEDNCEVHIKIENVNDNPPVFVSYQKTITIMEEELFPGCIAQLEAYDPDIPDRSAPQHILYFVVKEEQRMWLNINKKGCLSLIKPLDRDPPNGTESWQVLIGAKDEDGGPTGVQQTTEITITLTDINDNAPYLEMPQPVIWTENEPPGDIVKLNAEDNDGPENGRPFTFNIAPSATTEIQTKFTISGSTLKSLVRFDREERKSYFVPIAITDSGNPSLTGTSTLHVVIGDVNDNPMKSGYSEIFVYNYKGEAPDTEIGRVYVEDPDDWDLPDKRFEWAGMASPYFYLDPKTGMITMSQGTIDQSYILNFTVFENTTRYFSAHSVTATVNVTVKEIPEEAVDKSGSVRLVGITAEEFIESDSNGVSKRTMFRKYLAKFLNITEENVDVFTVLHSPHNTNTSLLDVRFSAHGSPYYSPEKLNAAVSVHNAELEKELGVVILMVNIDECLVERQYCEGSCINFLNKSREPIAVYTNTTTFVGVKAVVDPFCNCEVLSRPVCYNGGTLVGNDKCECEPGFEGPHCEILSVGFSGNGWALYPPLESCADSHLSLELRSNKKDGLVFYLGPTKPNRLLNVQDFISLEVVDGYPVLLLDFGTGTVKLDPKQIRLDDGEQHRIDIIWSRTTIELQVDNCKLPSCLSLKLKAGDNEFLNVNGPLQVGGSFVDFNYLDNHMNWTHKPSRVGFSGCVKNFTFNNKLYNLGMPGYSKNADIGCNAGVAVAVSFGIDPSFIIAIIICLAILLILLLAVVVHRRKTDDLYKDTDDIRENIINYEDEGGGEGDMTAYDLNVLRLMYNDAIQDKPLPDHLNSRPDEVPDICGFLDGKKQSVDNDPETNPFDDVRHYAYEGDGNTTGSLSSLASGTDEGDLNFDYLSNFGPRFRKLADIYGKDSSDDDDDDDNYQTTASESWC

SEQ ID NO: 665 - protein, 384 aa, Halymorpha halys
MSDEEYSESEEETVPEPEPQKKTERRQSEKGDGDPEFVKRQEAKTSALDEQLKDYIAEWRKQRAKEEEDLKRLKEKQAKRKVMRAEEEKRLAEKKKQEEERRVREAEEKKQRDIEEKRRRLEEAEKKRQAMMAALKDQSKSKGPNFTISKKEAGLNLSSAQIERNKTKEQLEEEKRISLSIRIKPLNIENLNIDRLRLKAIELWDCIVKLETEKYDLEERQKRQDYDLKELKERQKQQLRHKALKKGLDPEALTGKYPPKIQVASKYERRVDTRSYDDKKKLFEGGWETLTAEELEKIWKSRYEQFTKRKHAKLPKWFGERPGKKKDAPESPEEEEVKPTDDDVEPVYAEEEEAEEEAEEEEEEEEEAEEEEEEEEEEEEEEEE

SEQ ID NO: 666 - protein, 283 aa, Halymorpha halys; identical to SEQ ID NO: 504

SEQ ID NO: 667 - protein, 262 aa, Halymorpha halys
MAVGKNKGLSKGGKKGVKKKVVDPFTRKDWYDVKAPSMFNTRQIGKTLVNRTQGTKIASEGLKGRVFEVSLADLQNDTDAERSFRKFRLIAEDVQGRNVLTNFHGMDLTTDKLRSMVKKWQTLIEANVDVRTTDGYLLRVFCIGFTNKDQMSQRKTCYAQHNQVRAIRKKMVDNITNNISNSDLRIVVNKLIPDSIAKDIEKICQGIYPLHDVYIRKVKVLKKPRFELSKLLELHGDGKGSDEPGSKVSRPEAYEPPVQESV

SEQ ID NO: 668 - protein, 220 aa, Halymorpha halys
MGRRPARCYRYCKNKPYPKSRFCRGVPDPKIRIFDLGKKKARVDDFPLCVHLVSDEYEQLSSEALEAGRICANKYLVKNCGKDQFHIRMRLHPFHVIRINKMLSCAGADRLQTGMRGAFGKPQGTVARVHIGQPIMSVRSSDRYKAAVIEALRRAKFKFPGRQKIYVSKKWGFTKYDRETFEELRADGKLENDGCNVKYRRDHGPLSNWKKVQVELAAAS

SEQ ID NO: 669 - protein, 320 aa, Halymorpha halys
MSYIYVVEGCKLHHVHPLRSERAYIQESTLPLSSYREREVKKRNGAEFKACFREGTYHFHALRLFLKPFCEWIDHAVFHVSDKMTCATPISKKKKFVADGVFRAELNEFLTRELAEEGYSGVEVRETPSRTEIIIMATRTQSVLGEKGRRIRELTSVVQKRFNFQPQSLDLYAEKVPTRGLCAIAQAESLRYKLIGGLAVRRACYGVLRFIMENGAKGCEVVVSGKLRGQRAKSMKFVDGLMIHSGDPCNEYVNSATRHVLLRQGVLGIKVKIMLPWDPTGKNGPKNPLPDNVCVVNPKDEVIPSDIKTMGIELHPPAII

SEQ ID NO: 670 - protein, 118 aa, Halymorpha halys
MSKAELACVYSALILADDDVAVTGEKIQTILKAAGVDIEPYWPGLFAKALEGVNVKDLITNISSGVGVGGGAPAGAPAGGAAPAAAAAPAGGDKKKEEKKKEESEPESDDDMGFGLFD

SEQ ID NO: 671 - protein, 218 aa, Halymorpha halys
MSFLSKVFLGKKEEKAPTASEAIQKLRETEDMLIKKQDFLEKKIESELILVKKNGTNNRRVAIQALKRKKRYEKQLQQIDGTLATIEMQREALEGANTNTAVLQTMKFAADALKTAHKHMDVDQVHDMMDEIAEQQDVAKEISEAISNPVAFGNDIDEEELEKELEELEQEELDRELLGTGPTADQLPDVPATQLPTKPKPIASEDDEELRQLQQWAT

SEQ ID NO: 672 - protein, 151 aa, Halymorpha halys; identical to SEQ ID NO: 510

SEQ ID NO: 673 - protein, 430 aa, Halymorpha halys
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFAPTRVWRRWHRKVNVNQKRYAMVSAIAATGVPALVMSKGHMVNEVPEIPLVVTDKIQEYTKTKQATIFLHRIKAWSDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSEEIKSVLKAPRKTIVRRVRKLNPLRNTRAMLKLNPFAAVLKRKAVLADRKLKLERAIERSKKEGIELTPHQKRYVAMLERRKAQIKAAKAAKPKKVKKPKADKPAATEAKKATVTKKPAKKATTAVAPKPTKK

SEQ ID NO: 674 - protein, 204 aa, Halymorpha halys; identical to SEQ ID NO: 353

SEQ ID NO: 675 - protein, 1362 aa, Halymorpha halys
MSPPGHLQGVVGCEVGDPLTWNKMSGAASGSSTKKRKKPENKPQSQINKCLNEKRRREQENIYIEELAELISASFTDMSSLSVKPDKCAILQETVLQFAALQIKTIKGGAATSDAVQQGEVSSSKPTILTNEVFGPLLLEALEGFLFVVNPEGKVEFCTENITQFIKYRREEVLGQPVYNIIHHGDHARFSSWLLPMSWSNDYHPPRPRTFNCRFLIKPPPDTTVEEKQQRPYLYENMQISSTQLPQSSGVDKDDDGSSESGPCLMCVARRIPACEKPAGSPIEQFTMKLNTSGGIINVDNTGVSAPYSQYFSKDHLKNRNLDELVQSSDVPKVVAHIKEALSTGQSSSSIYKLQIGHEKFVHVQTKFKLFKSANRQMENDFLMATHSIFGDNEVNMEIGSPAGSNSQSGSGNNSNQQQQHQQQQQQQSSSTSGVGGPLIASVNGANNRDLSNTITLNNSSAFHSVTLNSNDLDFNFDIFPSSSTWDLSSDERVWERPESRQSLTPVESPLYSNPPAQSPATTPFSTPYAFSPIQETTQEEPPEEDSGKLRKILMTKRPSTESDDGGGGIIAQRNRHQILKILLNQEDEESQPQDSKPPNNMLLKLLNTQSDDDDVEARAGLKKQNELLHQLLKEEDNNRENQQSGDDILKSLGFRGEGGDENRGGRKRPSSDECEDQPGSKRSSSSLLDAVPPPPNSSTPSAASGKSRLWEKNQMLASLLAKRPTTPASIPPIPASVISATPQDKLQRLVKHPQTRKYRYNSGYACDTVTITVSTGWSGGSVQTGAGSPGQSRSGRSPGYTGANTWDSASSDPVLSDILDQVIEIVPDVNTDAPVLMNMINSMETETQHPQSAQQQFASQHEFLNEKMAINAIQKSLMLCESAVKSPTYSNTMSQGSPQPQPQPQPQPQPQPQPQPQPQPQQPFHPPPMYQQRQRYPLQQQQQQQQQQQQQQQQQQQQQQIRQPFNISPMILAQRNKLHHQQQMQQKQRLLQLQQQQQLVIPSNATAPNADPALHNIDSLINNTVAPNVSLQVRSSSVPDSQLSPVGSYPGLGSVPSPGQRRAYSPVNGGMTSFSSAGGTGPPVSGSGPQARLSPSSLQGYQQQPQLSPRLPQGQQSYGGGSATWSQQNSRLSLQQQENPVLNAQLTSGGRGYARANSAGLPSVRSLAGQQRFPTAADQQSGAASYQFRLQRQVSAPPPQQSSPNPQLPGGTRVGYGGGLGSPPLCHHPPGAYHPDQQYCYQPDQAYPPRLLLHSHGGNNGVTEYVRQELRAMVGARTSGSGRPQVPGSLPLPTPAVDLDSLPYDMQPQGVNDSPKMWGGMNEMGTSSPQPTQQLSSRSTMEEVSRSNDQKSSLLQKLLSE

SEQ ID NO: 676 - protein, 136 aa, Halymorpha halys
MGKIMKAGKVVLVLSGRYAGRKAIVLKTCDEGTQEKAYGHAIVAGIDRYPRKVHKRMSKTKIHKRSKIKPFLKVMNYNHLMPTRYTVSEIAPDQKVVTKDLKDPMKKKKIRFQVRVKFEERYKQGKSKWFFEKLRF

SEQ ID NO: 677 - protein, 198 aa, Halymorpha halys; identical to SEQ ID NO: 515

SEQ ID NO: 678 - protein, 1970 aa, Halymorpha halys
MASKGPAGMQKGADDPDPTPYLFVSLEQKRIDQTKPYDAKKACWVPDEAEGFVLGEIQGTKGDIVSVKLPSMETKDFKKDLVGQVNPPKFEKCEDMSNLTYLNDASVLYNLKQRYYHKLIYTYSGLFCVAINPYKRFPVYTMRCAKLYRGKRRNEVPPHIFAISDGAYVNMLTNKENQSMLITGESGAGKTENTKKVIAYFATVGASTKKEEASEKKGTLEDQVVQTNPVLEAFGNAKTVRNDNSSRFGKFIRIHFGPSGKLAGADIETYLLEKARVISQQTLERSYHIFYQIMSGAVKGVKELCLLSNDIYEYNYVSQGKITIAGIDDGEEMQLTDEAFNVLGFTQQEKDDIYKITAAVMHMGCMKFKQRGREEQAEADGLEEGIRVGKLLGIEGEELYKNLLKPRIKVGNEFVTQGRNVSQVTYSVGAMSKGMFDRLFKFLVKKCNETLDTKQKRQHFIGVLDIAGFEIFDYNGFEQLCINFTNEKLQQFFNHHMFVLEQEEYKKEGINWAFIDFGMDLLACIELIEKPMGILSILEEESMFPKATDKTFEDKLNTNHLGKSPNFQKPKPPKPGCQAAHFAIGHYAGVVSYNITGWLEKNKDPLNDTVVDQYKKGSNKLLCEIFADHPGQSAPAGADAGGKGGRGKKGGGFATVSSSYKEQLNNLMTTLRSTQPHFVRCIIPNELKQPGVIDSHLVMHQLTCNGVLEGIRICRKGFPNRMAYPDFKLRYKILNPAGVEKLTDEKAMAGVILESTGLDPDMYRLGHTKVFFRAGVLGQMEELRDERLSRIISWMQSYIRGYLCRKEFKKLQEQRLALQIVQRNLRRYLALRTWNWWKMWSKVKPLLNVANVEEEMRKLEELVAQTQAALEKEEKARKEVEALNAKLLQEKTELLRNLEGEKGTLGSLQERSAKLQAQKADLESQLMDTQERLQQEEDARNQLFQQKKKLEQENGSLKKDIEDLELSVTKSDQDKASKEHQIRNLNDEIAHQDELINKLNKEKKIQSEHNQKTAEELQAAEDKINHLTKVKAKLEQTLDELEDSLEREKKLRGDVEKAKRKTEGDLKLTQEAVADLERNKKELEQTIQRKDKEMASLTAKLEDEQGIVNKTGKQIKELQARIEELEEEVEAERQARGKAEKQRADLARELEELGERLEEAGGATSAQIELNKKREAEMSKLRRDLEEANIQHESTLANLRKKHNDAVSEMGDQIDQLNKLKTKVEKEKCQYLCELNDLRASIDHLTNEKAATEKIAKQLQHQLNEVQGKLDESNRSLNDFDAAKKKLSIENSDLLRQLEEAESQVSQLSKIKISLTTQLEDTKRLADEEARERATLLGKFRNLEHDLDNLREQVEEESEAKADIQRQLSKANAEAQLWRHKYESEGVARAEELEEAKRKLQARLAEAEETIESLNQKVIALEKTKQRLATEVEDLQLEVDRANAIANAAEKKAKAIDKIIGEWKLKVDDLAAELDASQKECRNYSTELFRLKGAYEEGQEQLEAVRRENKNLADEVKDLLDQIGEGGRNIHEIEKQRKRLEVEKDELQAALEEAEAALEQEENKVLRAQLELSQVRQEIDRRIQEKEEEFENTRKNHQRALDSMQASLEAEAKGKAEALRMKKKLEADINELEIALDHANKANAEAQKSIKKYQQQLKDVQTALEEEQRARDDAREQLGIAERRANALGNELEESRTLLEQADRGRRQAEQELTDAHEQINELAAQATSASAAKRKLEGELQTLHADLDELLNEAKNSEEKAKKAMVDAARLADELRAEQDHAQTQEKLRKALETQIKELQVRLDEAENNALKGGKKAIAKLEQRVRELENELDGEQRRHADAQKNLRKSERRIKELSFQSDEDRKNHERMQDLVDKLQQKIKTYKRQIEEAEEIAALNLAKFRKAQQELEEAEERADLAEQAVTKLRTKTGGRAGSTARAMSPVNRNPMRPLLDGSAFPPRFDLHQDDF

SEQ ID NO: 679 - protein, 255 aa, Halymorpha halys
MSSIGTGYDLSASQFSPDGRVFQVEYAQKAIENSGTVIGLRGKDGVVLAVEKLVTSKLYEPGANKRLFTIDKHIGMAVAGLISDARAVAEVARTEAANYRSQYKSSIPLKYLNERVSMYMHAYTLYSAVRPFGCSVILSTYTEEDGPEMYMIDPSGVSYGYFGCAVGKAKQAAKTEIEKLKLKELSCQELVKEAARIIYLVHDELKDKQFELEMSWIGSHTNGISQQVPPNVHAEAEKDAKAAMEEDSDSETEDI

SEQ ID NO: 680 - protein, 267 aa, Halymorpha halys
MVETSVVTPAASAAGNKKAGPTRKPQRRNYNLGSGVYRFSRTRMFHKKALWKFIGKKTPKNPRPKAKTTLEKKIGGEKNGGTRTVYLKKRTKSYPTANKVRKHPSKTYFCQHKRRFRASLKPGAVVILLAGLHKGKRAVLLKNMASGLLLVSGPFTLNGVPLRRIHPNYVIATSTQIDLSGVKLPEHMNDRYFKRVKAKKAKKSDGEIFAAKKELYKPSEQRKTDQKEVDKQILQAIKKHEHSLLLRKYLCTMFGLRSSQYPHRMKF

SEQ ID NO: 681 - protein, 243 aa, Halymorpha halys
MSTKDKLAIFPSRGAQTLMKGRLVGAQKGHSLLKKKADALQIRFRMILSKIIETKTLMGEVMKEAAFSLAEAKFATGDFNQQVLQNVQKAQIKIRTKKDNVAGVTLPVFESYQDGTDSYELAGLARGGQQLAKLKKNYQKAIKLLVELASLQTSFVTLDEVIKLTNRRVNAIEHVIIPRIERTLQYIISELDELEREEFYRLKKIQDKKRIARQKAEAKKAVDAAAATMANNILEENDEDLLF

SEQ ID NO: 682 - protein, 221 aa, Halymorpha halys
MAPKGNNMIPNGHFHKDWQRFIKTWFNQPARKYRRRIKRVKKARALAPRPAALLRPAVRCPTVRYHTKLRAGRGFTLEEIKRVGLCPGFARSIGIAVDHRRRNKSVESLQLNVQRLKEYQAKLILFPTKKSKKLKKGEASEEEQALATQVSSPVMPIKQTVIKMKARTITPEDKNFSAYGALRKARADVRLVGIRAKRLKEAADNPETVEKAAKTKKVKAK

SEQ ID NO: 683 - protein, 178 aa, Halymorpha halys; identical to SEQ ID NO: 362

SEQ ID NO: 684 - protein, 182 aa, Halymorpha halys; identical to SEQ ID NO: 363

SEQ ID NO: 685 - protein, 127 aa, Halymorpha halys; identical to SEQ ID NO: 364

SEQ ID NO: 686 - protein, 434 aa, Halymorpha halys
MPDYLGDDMRKTKDEMEGEEKDIKSLDEADIALLKTYGQGQYTKSIKSVEDDIQTIIKRVNELTGIKESDTGLAPPALWDLAADKQILQNEQPLQVARCTKIINADSEDPKYIINVKQFAKFVVDLADSVAPTDIEEGMRVGVDRNKYQIQIPLPPKIDPTVTMMQVEEKPDVTYSDVGGCNEQIEKLREVVETPLLQPEKFVNLGIEPPKGVLLFGPPGTGKTLCARAVANRTDACFIRVIGSELVQKYVGEGARMVRELFEMARSKKACLIFFDEIDAIGGARFDDGAGGDNEVQRTMLELINQLDGFDPRGNIKVLMATNRPDTLDPALMRPGRLDRKVEFGLPDLEGRSHIFKIHARSMSVERDIRFELLARLCPNSTGAEIRSVCTEAGMFAIRARRKVATEKDFLEAVNKVIKSYAKFSATPRYMTYN

SEQ ID NO: 687 - protein, 147 aa, Halymorpha halys; identical to SEQ ID NO: 525

SEQ ID NO: 688 - protein, 955 aa, Halymorpha halys
MAVVEQPCYTLINFPSDLEPPNEMQLKSDLENGDTKAKIEALKNIIHLIANGERLPGLLMHIIRFVLPSQDHTIKKLLLIFWEIVPKTTLDGKLLQEMILVCDAYRKDLQHPNEFVRGSTLRFLCKLKEPELLEPLMPAIRACLEHRVSYVRRNAVLAIFTIYRNFEFLAPDAPELIANFLDGEQDMSCKRNAFLMLLHADQERALSYLASCLDQVTSFGDILQLVIVELIYKVCHANPSERSRFIRCIYNLLNSNSPAVRYEAAGTLITLSNAPTAIKAAASCYIDLIIKESDNNVKLIVLDRLISLKEIPTHERVLQDLVMDILRVLASPDMEVKKKALSLALDLTTSRCVEEMVLMLKKEVAKTHNLTEHEDAGKYRQLLVRTLHSCCMKFPDVAASVIPVLMEFLSDTSELASYDVLIFVREAIHKFDSLRALIIEKLLEAFPTIKSMKVHRAALWILGEYTTSVTDIKEVMKQIKNALGEMPLVDDEMKRASGEKVEEVDHRDQVKLVTSDGTYATQSIFNTILAIKKEDRPPLRQYLIDGDFFIGVSVASTLVKLALRYKELVQQENIYHKFFAECMLIISSIVRLGKSGYPSKQLSYDDYERMLLCLKVLSENNAPIVKIFNTDCRNALANMLVAQQNEEYSLIKAKEKSVHTIQVDDPVSFLQLSTMRSSDFGSENVFELSLNQAVGGPNTAANTAELPFSASKLNKVTQLTGFSDPVYAEAYVHVNQYDIVLDVLIVNQTGDTLQNCTLELATLGDLKLVEKPQPCVLAPYDFCNIKANVKVASTENGIIFGNIVYDISGAASDRNVVVLNDIHIDIMDYIVPATCSDTEFRQMWAEFEWENKVSVNTYLVDLHEYLGHLLKSTNMKCLTPEKALCGQCGFMAANMYARSIFGEDALANLSIEKPFNKPNAPVTGHIRIRAKSQGMALSLGDKINMTQKKPTIMVQ

SEQ ID NO: 689 - protein, 167 aa, Halymorpha halys
MPFQRFVETGRIAYIADGPYQGKLCAIVDVINQTRALVDGPESGVPRCGIRLNQLHLTKFRIRFPFTASTRVVRKAWKDSNLDAKWKESVWAKKLEAKKIRASMNDFDRFRLNNARRTRSKITTNAFLLLKKQAKKAKKTEVKSDKKAKDKKPDAKKGAAKKAEKKK

SEQ ID NO: 690 - protein, 1680 aa, Halymorpha halys
MSQILPIRFQEHLQLSSVGINPTSVGFNTLTMESDKFICVREKVGETSQVVIIDLNDTANPIRRPISADSAIMNPASKVIALKGKAGPDGTTTQKTLQIFNIEMRSKMKAHTMTDEVVFWKWISLNTLALVTETSVYHWSMEGDSQPVKMFDRHSSLNGCQIINYRTDPKQTWLLLIGISAQLNRVVGAMQLYSVERKCSQPIEGHAASFAQFKMEGNPDVSTLFCFAVRTLQGGKLHIIEVGQPPTGNQPFSKKAVDVFFPVEAQNDFPVAMQVSSKYDVIYLITKYGYIHLYDLETATCIYMNRISIDTIFVTAPHESTGGIIGVNRKGQVLSVSVEEDHIIPYINNILQNPDLALRMAVRNNLAGAEDLFVKKFNMLFQNGQYAEAAKVAANAPKGILRTPQTIQQFQQIPNPQGQTSPLLQYFGILLDQGQLNKYESLELCRPVLAQGRKQLLEKWLKEDKLECSEELGDLVKQTDPTLALSVYLRANVPNKVIQCFAETGQFQKIVLYAKKVGYSPDYIFLLRNVMRVNPDQGVSFAQMLVQDEEPLADINQIVDILMEQNMVQQCTAFLLDALKNNRPSEGPLQTRLLEMNLISAPQVADAILGNQMFTHYDRAHIAQLCEKAGLLQRALEHYTDLYDIKRAVVHTHLLGPDWLVGYFGTLSVEDSLECLKAMLTANIRQNLNICVQIATKYHEQLTTKALIDLFESFKSYEGLFYFLGSIVNFSQDQEVHFKYIQAACKTGQIKEVERICRESNCYNPERVKNFLKEAKLTDQLPLIIVCDRFDFCHDLVLYLYRNNLQKYIEIYVQKVNPSRLPVVIGGLLDVDCSEDIIKNLMMVVRGQFSTEELVAEVEKRNRLKLLLPWLETRVHEGCVEPATHNALAKIYIDSNNNPERFLRENQYYDSCVVGKYCEKRDPHLACVAYERGQCDRELINVCNENSLFKSEARYLVRRKDPELWAEVLNENNPYKRPLIDQVVQTALSETQDPEDISVTVKAFMTADLPNELIELLEKIVLDNSIFSDHRNLQNLLILTAIKADRSRVMEYINRLDNYDAPDIANIAINYQLYEEAFAIFKKFDVNTSAIQVLIENVNNLDRAYEFAERCNEPAVWSQLAKAQLQHGLVKEAIDSFIKADDPSAYVDVVETAHKTESWEDLVRYLQMARKKARESYIESELIYAYARTNRLADLEEFISGPNHADIQKIGDRCFDDKMYEPAKLLYNNVSNFARLAITLVHLKEFQGAVDSARKANSTRTWKEVCFACVDSEEFRLAQMCGLHIVVHADELEDLINYYQDRGYFEELINLLEAALGLERAHMGMFTELAILYSKYKPGKMREHLELFWSRVNIPKVLRAAEQAHLWAELVFLYDKYEEYDNAVSAMMNHPTEAWREGHFKDIITKVANIELYYKAIQFYLDYKPLLLNDMLLVLAPRMDHTRAVNFFAKVNHLQLVKPYLRSVQSLNNKAINEALNNLLIEEEDFQGVRTSIDAFDNFDNIVLAQKLEKHELIEFRRIAAYLYKGNNRWKQSVQLCKKDRLFKDAMEYAAESKNSEVAEELLAWFLEKGNHDCFAACLFQCYDLLHPDVILELAWRHNIMDFAMPYIIQVTREYISKVDKLEESEARRLEERAEQDHKPMMMPEPQLMLTAGPGMIGPGFSPAYPNTFTTGMPYQGYGM

SEQ ID NO: 691 - protein, 156 aa, Halymorpha halys; identical to SEQ ID NO: 370

SEQ ID NO: 692 - protein, 193 aa, Halymorpha halys; identical to SEQ ID NO: 371

SEQ ID NO: 693 - protein, 277 aa, Halymorpha halys
MAGVLATERTLPGFSFENCKRNSILLQQGFKPPTAQKTGTTIVGIIYRDGVILGADTRATEGSTVADKNCSKIHFLADNIYCCGAGTAADTEMTTMTIMSQLELHRLNTGRPVRVSTAKQLLKQLLFRYQGHIGAALVVGGVDVTGPLLYSIHPHGSSECLPFTTMGSGSLAAMTVLESSWKPDLNEEEGKVIVRNAIAAGIFNDLGSGSNVDICIIRKGSVDYIRPFDVANLKGQKQNNYRFRRGTTGVLSTRIIPLVTESEEIKKTEVESMDTSA

SEQ ID NO: 694 - protein, 234 aa, Halymorpha halys
MGSERYSFSLTTFSPSGKLVQIEYALAAVAAGAPSIGIRASNGVVLATENKYKSILYEEHTIQKVEMITKHIGMVYSGMGPDYRLLVKRARKMAQQYQLVYGEPIPTAQLVQRVAMVMQEYTQSGGVRPFGVSLLISGWDGDKPSLFQCDPSGAYFAWKATAMGKNFVTGKTFLEKRYSETLELDDAVHTAILTLKENFEGQMTSDNIEVGVCDAQGFRVLDPTTVKDYLANIP

SEQ ID NO: 695 - protein, 288 aa, Halymorpha halys
MAPAKKPAPASKKVPTTTVTSGKAGKATATATKAAPAPAAKAAAAKSAAPSSAKPASAKQPAPAPKAAQPKAQAKPAAQQQKSTKPQQQTKAAATAKAQAKPAAQAKPAAPAAAPKQPAAPAAAGTQPAPAAPKKAPSGAVKKATTAPKKSQNLQKKSHQGVRKQVLKGKGQKKKKVSLKFIIDCTHPYEDKIMDVANFEKYIQERFKVNGKTNNLGNNVTLERNKMKITVTSDVHFPKRYLKYLTKRYLKKNNLRDWLRVVSSSKDTYELRYFQFNSQDDDDEEDND

SEQ ID NO: 696 - protein, 116 aa, Halymorpha halys; identical to SEQ ID NO: 375

SEQ ID NO: 697 - protein, 299 aa, Halymorpha halys
MGFVKVVKNKQYYKRFQVKFKRRQEGKTDYYARKRLIVQDKNKYNTPKYRLIVRLSNKDITCQVAYSRIEGDKILCAAYSHELPHFGIKVGLTNYAAAYCTGLLLARRLLQKLKLDALYEGTTDVTGDEYNVENLDEGPGAFRCYLDVGLMKTSAGARVFGALKGAVDGGLNIPHSMKRFPGYDFESKEFNAEVHRKHIFGIHVADYMRQLAESDEDAYKKQFSIYIKNGIVPDAIEDIYKKAHAAIRENPAPRPKVRSKEAIKKRWNRAKLTLAERKNCIAQKKAAFLKKMKAGEVDA

SEQ ID NO: 698 - protein, 1141 aa, Halymorpha halys
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGY

SEQ ID NO: 699 - protein, 447 aa, Halymorpha halys
MADDEAKKAKQAEIERKRAEVRKRMEEASRGKKAKKGFMTPDRKKKLRLLLRKKAAEELKKEQERKAAERRRIIEERCGKICDVDNASEATLKKICQDYHKRIDALERSKIDIEFEVERRELEIADLNSQVNDLRGKFVKPTLKKVSKYENKFAKLQKKAAEFNFRNQLKVVKKKEFTLEEEDKEKKGGIVDWSKKDEKAKVEVEDEDEESVSEALPSAAEETIASEASELPQDEPPPPLEPEPEPEPLPPPPPPKTEEDLWLFLREAVTQANPLSIDELLHKLLDTVNAVPQDFLEPVVEASIKRSQSMQSMDLSHAESLPADGEPPKEGEPGEQPPATEGVAGVPAEGEAKVEQGGEGNAAEKAPQAESPAAESAPVQEQQPADQPPAQSPTEPPAQVPTEPPAQVPTEPPAQVPTEQPAAPPAGEQPPPPQAEQPQPQIVEAAA

SEQ ID NO: 700 - DNA, 20 bp, artificial sequence
  Piezodorus guildinii
gctcccaaatatgaaatggc

SEQ ID NO: 701 - DNA, 20 bp, artificial sequence
  Piezodorus guildinii
agttcttccctcttcctctt

SEQ ID NO: 702 - DNA, 20 bp, artificial sequence
  Piezodorus guildinii
attaagcacatgatggcctt

SEQ ID NO: 703 - DNA, 20 bp, artificial sequence
  Piezodorus guildinii
tgggctgaaataagatcgag

SEQ ID NO: 704 - DNA, 20 bp, artificial sequence
  Piezodorus guildinii
ggaattcagcagttattggc

SEQ ID NO: 705 - DNA, 20 bp, artificial sequence
  Piezodorus guildinii
cgcttctttgttggcattta

SEQ ID NO: 706 - DNA, 20 bp, artificial sequence
  Piezodorus guildinii
actttgcctgcagaatatga

SEQ ID NO: 707 - DNA, 20 bp, artificial sequence
  Piezodorus guildinii
cactgagcaccattgaaatc

SEQ ID NO: 708 - DNA, 20 bp, artificial sequence
  Piezodorus guildinii
gcagatcttcgttaaaaccc

SEQ ID NO: 709 - DNA, 20 bp, artificial sequence
  Piezodorus guildinii
ttagttgctcttgggtgaag

SEQ ID NO: 710 - DNA, 20 bp, artificial sequence
  Piezodorus guildinii
gtcttgcggaacaaattagg

SEQ ID NO: 711 - DNA, 20 bp, artificial sequence
  Piezodorus guildinii
tcctcacggctttcataaaa

SEQ ID NO: 712 - DNA, 20 bp, artificial sequence
  Piezodorus guildinii
gatcttgaagctgggatagg

SEQ ID NO: 713 - DNA, 20 bp, artificial sequence
  Piezodorus guildinii
gaatacggctcaatgatcct

SEQ ID NO: 714 - DNA, 20 bp, artificial sequence
  Piezodorus guildinii
gaaacatggtgtcattccac

SEQ ID NO: 715 - DNA, 20 bp, artificial sequence
  Piezodorus guildinii
gaggctccttgacagttatc

SEQ ID NO: 716 - DNA, 20 bp, artificial sequence
  Piezodorus guildinii
attgaagctacagaagaggc

SEQ ID NO: 717 - DNA, 20 bp, artificial sequence
  Piezodorus guildinii
ttcttctcgtcgcttcttag

SEQ ID NO: 718 - DNA, 20 bp, artificial sequence
  Piezodorus guildinii
aatttgtttatagcgacggg

SEQ ID NO: 719 - DNA, 20 bp, artificial sequence
  Piezodorus guildinii
tagtctgagagtacctgtgg

SEQ ID NO: 720 - DNA, 20 bp, artificial sequence
  Piezodorus guildinii
acatggaaaagatctggcat

SEQ ID NO: 721 - DNA, 20 bp, artificial sequence
  Piezodorus guildinii
ggagcgatgatcttgatctt

SEQ ID NO: 722 - DNA, 20 bp, artificial sequence
  Piezodorus guildinii
ccttcatatacacctgcgaa

SEQ ID NO: 723 - DNA, 20 bp, artificial sequence
  Piezodorus guildinii
tcctgtctataactggcaga

SEQ ID NO: 724 - DNA, 20 bp, artificial sequence
  Piezodorus guildinii
tggtggtacaaatgtgagag

SEQ ID NO: 725 - DNA, 20 bp, artificial sequence
  Piezodorus guildinii
taggcatttcttcgatacgg

SEQ ID NO: 726 - DNA, 20 bp, artificial sequence
  Piezodorus guildinii
aagtcatggatgttggacaa

SEQ ID NO: 727 - DNA, 20 bp, artificial sequence
  Piezodorus guildinii
ggcaagcctcttatctcttt

SEQ ID NO: 728 - DNA, 20 bp, artificial sequence
  Piezodorus guildinii
aactggacgtttagaggttc

SEQ ID NO: 729 - DNA, 20 bp, artificial sequence
  Piezodorus guildinii
aggtctcagaatagcaggat

SEQ ID NO: 730 - DNA, 20 bp, artificial sequence
  Piezodorus guildinii
aggagtagtgaggaatggaa

SEQ ID NO: 731 - DNA, 20 bp, artificial sequence
  Piezodorus guildinii
tgagtacatctaggtgaggt

SEQ ID NO: 732 - DNA, 20 bp, artificial sequence
  Piezodorus guildinii
acgtggtaaaggtggtaaag

SEQ ID NO: 733 - DNA, 20 bp, artificial sequence
  Piezodorus guildinii
ctcttctctgtcttcttcgg

SEQ ID NO: 734 - DNA, 20 bp, artificial sequence
  Piezodorus guildinii
tactcgacacagtttcgatc

SEQ ID NO: 735 - DNA, 20 bp, artificial sequence
  Piezodorus guildinii
actagtctcagaagccagat

SEQ ID NO: 736 - DNA, 20 bp, artificial sequence
  Piezodorus guildinii
agcctcaaaagaagactgag

SEQ ID NO: 737 - DNA, 20 bp, artificial sequence
  Piezodorus guildinii
gatatttgccagtcaaagcc

SEQ ID NO: 738 - DNA, 20 bp, artificial sequence
  Piezodorus guildinii
tcaagaagaagatgcaagct

SEQ ID NO: 739 - DNA, 20 bp, artificial sequence
  Piezodorus guildinii
cgacttccttctgcaatttc

SEQ ID NO: 740 - DNA, 20 bp, artificial sequence
  Piezodorus guildinii
aaataaggggctctccaaag

SEQ ID NO: 741 - DNA, 20 bp, artificial sequence
  Piezodorus guildinii
ataagcttcaggccttgaaa

SEQ ID NO: 742 - DNA, 20 bp, artificial sequence
  Piezodorus guildinii
gctactgcaaaaacaaacct

SEQ ID NO: 743 - DNA, 20 bp, artificial sequence
  Piezodorus guildinii
atgatccctcctgtacttca

SEQ ID NO: 744 - DNA, 20 bp, artificial sequence
  Piezodorus guildinii
agagaacttgctgaagaagg

SEQ ID NO: 745 - DNA, 20 bp, artificial sequence
  Piezodorus guildinii
gctggaggatgtagttcaat

SEQ ID NO: 746 - DNA, 20 bp, artificial sequence
  Piezodorus guildinii
gcttgtgtatactctgcact

SEQ ID NO: 747 - DNA, 20 bp, artificial sequence
  Piezodorus guildinii
gtgatgaggtccttgacatt

SEQ ID NO: 748 - DNA, 20 bp, artificial sequence
  Piezodorus guildinii
aaagaagaaaaagcacccac

SEQ ID NO: 749 - DNA, 20 bp, artificial sequence
  Piezodorus guildinii
ttctgatgcaattggctttg

SEQ ID NO: 750 - DNA, 20 bp, artificial sequence
  Piezodorus guildinii
tatcgaagaagtgtcccaac

SEQ ID NO: 751 - DNA, 20 bp, artificial sequence
  Piezodorus guildinii
ctcgtacttccagttaggtg

SEQ ID NO: 752 - DNA, 20 bp, artificial sequence
  Piezodorus guildinii
tatcaaggcctggtctgata

SEQ ID NO: 753 - DNA, 20 bp, artificial sequence
  Piezodorus guildinii
ctagctttctttgcttcagc

SEQ ID NO: 754 - DNA, 20 bp, artificial sequence
  Piezodorus guildinii
gttaaaatcgcaaaggcctt

SEQ ID NO: 755 - DNA, 20 bp, artificial sequence
  Piezodorus guildinii
agggaatttctcttgcgaat

SEQ ID NO: 756 - DNA, 20 bp, artificial sequence
  Piezodorus guildinii
ttcaacaacagccacaaatc

SEQ ID NO: 757 - DNA, 20 bp, artificial sequence
  Piezodorus guildinii
catactctgtcacgccatta

SEQ ID NO: 758 - DNA, 20 bp, artificial sequence
  Piezodorus guildinii
aatattgttagggcggactg

SEQ ID NO: 759 - DNA, 20 bp, artificial sequence
  Piezodorus guildinii
tttcgaaaaaccacttgctc

SEQ ID NO: 760 - DNA, 20 bp, artificial sequence
  Piezodorus guildinii
aaataagaaaaagggcgctg

SEQ ID NO: 761 - DNA, 20 bp, artificial sequence
  Piezodorus guildinii
ctgttggaaccatttcatcg

SEQ ID NO: 762 - DNA, 20 bp, artificial sequence
  Piezodorus guildinii
tgtacagaggtaagaggagg

SEQ ID NO: 763 - DNA, 20 bp, artificial sequence
  Piezodorus guildinii
gagtttaccgaccctgatac

SEQ ID NO: 764 - DNA, 20 bp, artificial sequence
  Piezodorus guildinii
ggaacagggtatgatctgtc

SEQ ID NO: 765 - DNA, 20 bp, artificial sequence
  Piezodorus guildinii
tgttgacttacaccattcgt

SEQ ID NO: 766 - DNA, 20 bp, artificial sequence
  Piezodorus guildinii
atggttgaaacatctgtggt

SEQ ID NO: 767 - DNA, 20 bp, artificial sequence
  Piezodorus guildinii
ttaatggcctgcaaaacttg

SEQ ID NO: 768 - DNA, 20 bp, artificial sequence
  Piezodorus guildinii
ccaaagacaaattggccatt

SEQ ID NO: 769 - DNA, 20 bp, artificial sequence
  Piezodorus guildinii
ttcttcgcttctgctttttg

SEQ ID NO: 770 - DNA, 20 bp, artificial sequence
  Piezodorus guildinii
tcaatcaaccagctcgtaaa

SEQ ID NO: 771 - DNA, 20 bp, artificial sequence
  Piezodorus guildinii
ttttcttctgttttgcagcc

SEQ ID NO: 772 - DNA, 20 bp, artificial sequence
  Piezodorus guildinii
tgtttgcagcaggttatagt

SEQ ID NO: 773 - DNA, 20 bp, artificial sequence
  Piezodorus guildinii
gttcaccaagtgggatatca

SEQ ID NO: 774 - DNA, 20 bp, artificial sequence
  Piezodorus guildinii
cctgtttggcaaaaaggaaa

SEQ ID NO: 775 - DNA, 20 bp, artificial sequence
  Piezodorus guildinii
caatctaggccttcgtagag

SEQ ID NO: 776 - DNA, 20 bp, artificial sequence
  Piezodorus guildinii
acgaagttaatcccaaagct

SEQ ID NO: 777 - DNA, 20 bp, artificial sequence
  Piezodorus guildinii
aagcctctcaatgtcttgtt

SEQ ID NO: 778 - DNA, 20 bp, artificial sequence
  Piezodorus guildinii
ggagaaggaggaagaaaagg

SEQ ID NO: 779 - DNA, 20 bp, artificial sequence
  Piezodorus guildinii
ttggacaagttctgaaccaa

SEQ ID NO: 780 - DNA, 20 bp, artificial sequence
  Piezodorus guildinii
acgtcattttactgctccat

SEQ ID NO: 781 - DNA, 20 bp, artificial sequence
  Piezodorus guildinii
cggtgtactttcctttgtct

SEQ ID NO: 782 - DNA, 20 bp, artificial sequence
  Piezodorus guildinii
aacgctctcgctaatatgtt

SEQ ID NO: 783 - DNA, 20 bp, artificial sequence
  Piezodorus guildinii
cagagagctttttctggagt

SEQ ID NO: 784 - DNA, 20 bp, artificial sequence
  Piezodorus guildinii
ttgaaacgggaagaatagca

SEQ ID NO: 785 - DNA, 20 bp, artificial sequence
  Piezodorus guildinii
tttgtccttaggcttctgtc

SEQ ID NO: 786 - DNA, 20 bp, artificial sequence
  Piezodorus guildinii
ggaaaccctgacgtatctac

SEQ ID NO: 787 - DNA, 20 bp, artificial sequence
  Piezodorus guildinii
agagttgggtctgtttgttt

SEQ ID NO: 788 - DNA, 20 bp, artificial sequence
  Piezodorus guildinii
ctcacgggtaagaccattac

SEQ ID NO: 789 - DNA, 20 bp, artificial sequence
  Piezodorus guildinii
aggcttattgaagacaaggg

SEQ ID NO: 790 - DNA, 20 bp, artificial sequence
  Piezodorus guildinii
atgaaaaggctcgtctagac

SEQ ID NO: 791 - DNA, 20 bp, artificial sequence
  Piezodorus guildinii
atcttcgtcttcttctgcag

SEQ ID NO: 792 - DNA, 20 bp, artificial sequence
  Piezodorus guildinii
cttagccactgagagaactc

SEQ ID NO: 793 - DNA, 20 bp, artificial sequence
  Piezodorus guildinii
gactctgtcaccaaaggaat

SEQ ID NO: 794 - DNA, 20 bp, artificial sequence
  Piezodorus guildinii
agagcaaggatagtgactct

SEQ ID NO: 795 - DNA, 20 bp, artificial sequence
  Piezodorus guildinii
tgggtctaaaactctgaagc

SEQ ID NO: 796 - DNA, 18 bp, artificial sequence
  Piezodorus guildinii
ccagttctgctaagccag

SEQ ID NO: 797 - DNA, 20 bp, artificial sequence
  Piezodorus guildinii
ttcatcatcatcatcctggc

SEQ ID NO: 798 - DNA, 20 bp, artificial sequence
  Piezodorus guildinii
aaggaggaatggaggaagat

SEQ ID NO: 799 - DNA, 20 bp, artificial sequence
  Piezodorus guildinii
tcagccttagaacgattacg

SEQ ID NO: 800 - DNA, 20 bp, artificial sequence
  Piezodorus guildinii
cgacgagaaggtaaaacaga

SEQ ID NO: 801 - DNA, 20 bp, artificial sequence
  Piezodorus guildinii
ctccttactccttacacgtg

SEQ ID NO: 802 - DNA, 20 bp, artificial sequence
  Piezodorus guildinii
caccggcaaaacaataacat

SEQ ID NO: 803 - DNA, 20 bp, artificial sequence
  Piezodorus guildinii
aatggttttccctgtcagag

SEQ ID NO: 804 - DNA, 20 bp, artificial sequence
  Piezodorus guildinii
ggatggaggaggcctcaaga

SEQ ID NO: 805 - DNA, 22 bp, artificial sequence
  Piezodorus guildinii
ctacctttgccttttcatcctt

SEQ ID NO: 806 - RNA, 293 nt, piezodorus guildinii
gcucccaaauaugaaauggccguuggccuuaagaaaggucacaggacaacuaaaauuguuaugggaaaguccaaagcugacaaaaaacauaaaaucaggccaucucgucuaaaagguagacaaaccaagcacacuaaauuugugcgagacuugaucagagaaguuuguggucaugcaccuuaugaaaagagaggaauggaauugcucaagauuucuaaggauaagagggcuuugaaauucuugaagagaaggaucggcacacacauccgugcuaagaggaagagggaagaacu

SEQ ID NO: 807 - RNA, 584 nt, piezodorus guildinii
auuaagcacaugauggccuucauugagcaggaggccaaugaaaaggcugaagaaaucgaucaaaaagcugaagaagaauucaauauugagaaaggucggcuuguucagaaucaaagauuaaagauaauggaauauuaugaaagaaaagaaaaacaggucgaacuacaaaagaaaauccaaucuucaaauauguugaaccaagcucgacugaaagcuuugaaaauucgugaagaucaugugcgugaugugcucgaugaggccaggaagagacucuugcaaucagucaaagaugaggcucguuacaaagacauucuucagaaacuuaugcuucagggacuguuccaguugauggaaucagacauuuugguuagaacucgugaaacggauggcccaguugucagcucaguguuuccugaugugcuggucaaauacaaggaagcaucagguaaggauuugcaacuuaaguuggauacagagucguacuuaccaucugaaugugcuggcgguauugaacuauacacugcuagagggcguaucaagauuguuaauacucuugaauccaggcucgaucuuauuucagccca

SEQ ID NO: 808 - RNA, 264 nt, piezodorus guildinii
ggaauucagcaguuauuggcggcugagaaaagagcugcagaaaaaguugcugaggcgaaaaaacgcaaggcaaggcgccucaagcaagcuaaagaagaggcccaagaagaaauugagagguacaagcaagauagagaaaaacaguucagagaauuugaagcucagcauaugggaucucgagaagacguugcagcaaggauagaugcugauacccgccaaaagauugaggaaaugaaugaagcaguaaaugccaacaaagaagcg

SEQ ID NO: 809 - RNA, 701 nt, piezodorus guildinii
acuuugccugcagaauaugaugcaagagucaaagcuauggaaguugaugaaagacccacugaacaguauucugauauugguggacuagacaagcagauucaagaacuaaucgaagcuguuguucuuccuaugacccacaaagaaaaguuugaaaaucuuggaauucauccuccuaaagguguacuacuuuauggaccuccuggaacaggaaaaacauuauuggccagggcgugugcagcucaaacaaaaucaacuuuuuugaaacuagcugguccucagcuuguacaaauguucauuggggauggagcuaaacuuguuagagaugccuuugcucuugcuaaggaaaaaucuccagcaauuauauuuauugaugaauuagaugcuauugggacuaagagauuugauuccgaaaaggcuggagaucgagaaguucaaagaacuauguuagaguuacucaaccaguuagauggcuuuagcucaacugcugacauaaagguuauugcugcaacaaacagaguagauauuuuagauccugcccuuuugcguucaggaagacuggauagaaaaaucgaauucccucacccuaacgaagaugccagagcacguauaaugcaaauucauucccguaaaaugaacauuaguguugauguuaauuuugaagaacuugcucguucaacagaugauuucaauggugcucagug

SEQ ID NO: 810 - RNA, 324 nt, piezodorus guildinii
gcagaucuucguuaaaacccuuacggguaaaaccauuacccuagagguugaaccuucugauacuaucgaaaauguaaaagcuaaaauucaagacaaagaaggaauuccuccagaucaacaaaggcuuauuuuugcuggcaaacaguuggaagauggaagaacauuaucugauuacaacauucagaaagaaucuacucuucacuuggugcuucgucuuagggguggugucauugaaccaacucugaagauccuugcccagaaauacaauugugauaaaaugauuugccgcaagugcuaugcuagacuucacccaagagcaacuaa

SEQ ID NO: 811 - RNA, 708 nt, piezodorus guildinii
gucuugcggaacaaauuagggaacuucgugaggugaucgagcugccucuauugaauccagaacuuuuucaacguguugggaucacuccccccaaaggaugucuacuuuaugggccuccugguacuggaaagacuuuauuggcuagagcuguugccagccaauuagaugcuaauuuccugaagguuguuuccagugccauuguugacaaguauauuggugaaagugcucgucugaucagagaaauguuuaauuaugcaagggaucaucagccuugcauaauuuuuauggaugaaauugaugcuauugguggucgaagauucucagaagguacaucugcugaucgugaaauucaaagaacccuuauggaacuucuuaaccaaauggauggauuugauucauuaggacagguaaaaaugaucauggccacuaaucggcccgacacccuugacccagcucuccuccgucccgguagguuagacaggaagauugaaauaccacugccaaaugaacaggccaggcuagagauccucaagauccacgcuaguccuauuucgaagcauggagauauugauuacgaggcuguugugaaguugucugauaauuucaauggagcugauuugagaaauguuuguacugaagcuggucuuuuugcuauucgagcugaaagggaauauguaaugcaggaagauuuuaugaaagccgugagga

SEQ ID NO: 812 - RNA, 737 nt, piezodorus guildinii
gaucuugaagcugggauaggaauagaaguucaacuuuguaaagaguguauagaaugggcaaaagaugaacacaggacuuuccucaggcagucacuggaagccaggcuuaucgcucuauauuucgacacuggaauguucacagaagcacuccagcucggcucaagucuccuuaaggaauugaagaaguuagaugauaaaaauuugcuuguugaaguucuuuuguuggaauccaaaacuuaucaugcuuugaguaaucuuucuaaagcccgggcugcucugacaucggccaggacaacugcuaauucaauuuauuguccaccuaaaaugcaagcagcccucgauuugcagucugguauauuacacgcagcugacgaacaggauuucaaaacagcuuacucauacuuuuaugaagcauuugaagguuaugauaguguugacagcccgaaggcuuugguagcucuuaaguacaugcuuuugaguaaaaucauguugaauacgccagaagaugugcagcaacuaguuaguggaaaacuugcucuuaaacacgcugguaaagauaucgaugcaaugaaaucaguugcucaagcuagccauaagagaucccuugccgauuuucagauaacuuuaaagaauuacaagaaagagcuggaagaggauccgaucguaagagcucacuuggguacacuuuacgacaacauguuggaacagaauuuguguaggaucauugagccguauuc

SEQ ID NO: 813 - RNA, 380 nt, piezodorus guildinii
gaaacauggugucauuccacuuucgacuuacaugaaagucuauaaaguuggagacaucguaucaauuaaggguaauggagccguucaaaaagguaugccccacaaaaguuaucauggcaaaacaggacgaguuuacaauguuacucccagagcuuugggugugaucgucaacaaaaggguccguggaaaaauucuacccaagaggaucaacauccguauugagcacgucaaccacuccaaaugccgugaagauuucuugaagcguguccgagaaaaugaaaggcugaggaaggaggccaaagaaaaggguauucgaguugaauugaaaagacagccugcccagccacgaccugcucauuugauaacugucaaggagccuc

SEQ ID NO: 814 - RNA, 517 nt, piezodorus guildinii
auugaagcuacagaagaggcuagcagccucuguuaugaggugugguaaaaaaaagguuugguuagauccuaaugaaauuaaugaaaucgccaacaccaacucaagacaaaacaucaggaaguuaauaaaagaugguuuuaucaucaagaaaccuguugcaguacauucuagagcccguguccguaaaaauacugaagccagaaggaaagguaggcauuguggcuuugguaaaaggaaagguacugcuaaugcaagaaugccagcaaagguuuugugggugaacagaaugaggguucuuaggcgguuauuaaagaaguauagggaagccaaaaaaauugacaggcagauguaucaugacuuauacaugaaagcuaaagguaacguuuucaaaaacaagcguguacuuauggaauucauucacaagaagaaggcugaaaaagcuaggucuaagaugcuucgugaucaagcugaagccaggaggcagaagguuaaagaagcuaagaagcgacgagaagaa

SEQ ID NO: 815 - RNA, 712 nt, piezodorus guildinii
aauuuguuuauagcgacgggccauaugggcuuguuucgucgguugcuuaucagcuguucacagccuucauuaucggaagcagcgccgauacagccagccuuggcaaaguauccagaaagcucuucgcucacguuaccguguuucccaaagccuucauuuacaaugggggcuuacaaguacauucaggaacuguacagaaaaaagcagucagaugccaugcgguaucugcugcguaucaggguuuggcaauaccgacagaugaccaagaugcaccgcgucgugaagccaucaaggccagacaaagccagaagauugggauuuaagaauaagcaagguuucugcaucuucaggauccguaucaagaggggagguaggaaacgcccagucccaaagggugccaccuacggcaaaccuaaaagccauggagucaaccagcucaagccuacaaggagucuucacgccauggcugaggagaaaguugguaggaggugcagcggauugaggguacucaacuccuauugggucgcccaagacgcuagguacaaguacuaugaggucaucugcauugacccggcucacaaggcuaucagaagagacgcuaaggccaacuggauaugcgacccagugcacaagcaccgugagaugcgcggcaagaccagcgccgccaggaagucucgaggcuugggcaagggccacagguacucucagacua

SEQ ID NO: 816 - RNA, 754 nt, piezodorus guildinii
acauggaaaagaucuggcaucacaccuucuacaacgagcugcgagucgcuccagaggaacaccccauccuccucacugaggcuccccucaaccccaaagcuaacagggagaagaugacccagaucauguuugagaccuucaacaccccagccauguaugucgccauccaggcuguacucucccucuacgccuccggucguaccaccgguauuguacuugacucaggagauggugucucccacaccguacccaucuaugaagguuaugcccuuccccacgccauccuccgucuggaucuugcuggacgugacuugacugacuaucuuaugaagauccucaccgagcgugguuacagcuucacuaccaccgcugaaagggaaauugucagggacaucaaggaaaaacugugcuaugucgcccuggacuuugagcaggaaauggccaccgcugccgccuccaccucccucgagaaguccuaugaacuucccgacggucaggucaucaccaucgguaacgagagguuccguugcccagaggcucucuuccagccuuccuucuuggguauggaaucuugcgguauccaugagacugucuacaacuccaucaugaagugcgauguugacaucaggaaggaccuguacgccaacacuguccuuuccggagguaccaccauguacccagguauugcugacaggaugcagaaggaaaucaccgcccucgcuccuucaaccaucaagaucaagaucaucgcucc

SEQ ID NO: 817 - RNA, 709 nt, piezodorus guildinii
ccuucauauacaccugcgaaaccugucuuaucagcaaaagcuaugaaacuuggugguaaaucaagagauguugaaucauuuguugaucaacugaaaucugagggagaaaauguuaucucacaaguagcuguaaauaagccuguugcggccaaguuagcuucuucgccaaauauucacauggaagagguccaucugaagcaggaagaaaagcugaugguuucuguuggaaaggaugguggaauacagagcuucgagcuccauggccuuguaacuuuacggauaacugaugaaaaauaugcaaagauaaaaguauaucuugacaauaaagauaagagaggaauucaguugcagacacauccuaauguggauaaagaauuguucaaacugaaaucucagauagguuugaagaauccuucaaaaccauuucccuuaggaacugauguagguguacuuaaauggcgguaccaaucucaagaugaaucugcacuuccucuuacuauuaauuguuggccaucagaaaauggacaaggagggugugaugucaauauugaguaugaacuugaacaugcucaucuugaacuaaaugauguuaccaucaacauuccauuaccuauugggugcucucccguuguugcugagugugauggugaguacaagcaugagucccgaaggaacuugcuccaguggguucugccaguuauagacagga

SEQ ID NO: 818 - RNA, 791 nt, piezodorus guildinii
uggugguacaaaugugagagaagacaugcguaaauuagaaaugggagugcauguuuuaguuggaacuccaggacgaguuuuggauaugauuagccgcagggcucuaaaaacaaauacuauuagaauuuuuguguuggaugaagcugaugagaugcuuucucgugguuucaaagaucagauccaugauguauuuaaaaauuugaaucaugaaguacagguuauauugcuuucagcuacuaugccaucagauguauuggaugucaguacaugcuucaugaggaauccuauucguaucuuaguuaaaaaggaagaacuuaccuuggaagguaucaaacaguuuuuuguauuuguugagagggaagaguggaaguuggauacucuuugugauuuguaugaaacucuaaguauuacccaagcuguaauuuucuguaauacaaggcguaaggucgauuggcugacugagaacaugcauaauagagacuucacuguuucugcuaugcauggagauauggagcaaagagagcgagauauaauuaugcggcaguuccguacugguuccagcagaguuuugaucacuacugaccuuuuggcuagaggcauugaugugcagcaaguuucucuugucaucaauuaugaucuuccaucaaauagagaaaauuauauucacaggauuggaagagguggccgauucggucguaaagguguggcgauuaacuuuguaacagaagaggacaaacgcucucuuaaugauauugaacaguucuacaauacccguaucgaagaaaugccua

SEQ ID NO: 819 - RNA, 726 nt, piezodorus guildinii
aagucauggauguuggacaagcuuggugguguuuuugcccccagacccagcucugguccacacaaacugagggaauccuugcccuuagucauuuuccuucguaacagacuaaaguaugcucugaccaauacugaagugacaaaaauuguaaugcaaagguugaucaaaauugaugguaaaguuaggacagacccuaacuauccugcugguuucauggaugugaucagcauugagaaaacuggugaauuuuuccgguuaauuuaugacguuaaaggacguuaugccauucauaggauuacuggugaugaagccaaguacaagcuguguaaaguuaaaagagugcagacuggaccuaaggguauaccuuauuuagugacacacgacgcuagaaccaucagguacccagauccacuugucaaaguccaugacaccauucagcuugauauugccacuggcaaaaucauugauaucauccgaauggagucagguaaucuuugcaugauuacugguggccguaacuugggaagaguaggaacuguagugaacagggagagacauccugguucuuuugauauuguccauauuaaggaugcuaguggacauaccuuugccacacgauugaacaauguguucauuauuggaaagggcagcaaagcauacguuucauuaccuaagggcaagggugugaagcucaguauugcugaagaaagagauaagaggcuugcc

SEQ ID NO: 820 - RNA, 787 nt, piezodorus guildinii
aacuggacguuuagagguucuucgaauucauacaaaaaauaugaaacuagcugaugaugucaauuuagaacagauugcugcugaaacacauggucauguuggagcagauuuggcaucucucuguucagaagcagcacuucagcagauccgugaaaaaauggaucuaauugauuuagaagaagagcaaauugaugcagaaguucuaaacuccuuggcuguuacuauggauaacuuccgguaugcuaugggcaaaaguagcccaagugcccuucgugaaacugugguugaaguuccaaauauuacuugggaugauauugguggucuggauaauguuaaaaaggaauugcaagaauugguucaguacccuguugaacauccagaaaaauucuugaaauuuggaaugcaaccuucccgugguguuuuauuuuauggaccaccagguugugguaagacauuguuagcuaaagcuauugcuaaugaaugucaggcaaacuucauuucagucaaggggccagaauuauuaacuaugugguuuggagaaucagaagcuaauguucgugauauuuuugauaaggcuagagcugcugcaccauguguucuauuuuuugaugaacuggauuccauugcuaaaucaagagguggaaguguuggagaugcuggaggugcagcugauagaguuaucaaccaaauccuuacugaaauggauggaaugggagccaagaaaaauguuuuuauaauuggggcuacuaauagaccagacauaauugauccugcuauucugagaccu

SEQ ID NO: 821 - RNA, 305 nt, piezodorus guildinii
aggaguagugaggaauggaauaauuguucauggucugagggagucagcuaaagcucuugacaagcgacaggcuuuacucugcguccuggccgaaaacugcgacgagcccauguacaagaaacucgugcaggcccucugcuccgaacaucaaauaccauuaguuaaggucgacucaaacaagaagcuaggagaaugguccgguuuauguaaaauugacaagacaggaaacccaaggaagguugucgggugcucauguguaguuauuaaggacuggggcgaugauacaccucaccuagauguacuca

SEQ ID NO: 822 - RNA, 360 nt, piezodorus guildinii
acgugguaaaggugguaaagccaaggguaaggcaaagacccgaucuucaagggcagggcuccaguuccccgucggucguauccaccgucuccucaggaaagguaacuacgccgagagaguaggugcaggagcuccgguguaucucgccgcagucauggaguaccuggcugcugaaguucucgaauuggccggcaacgcagcucgcgauaacaagaagacgaggaucauuccgcgucaccuccagcucgcuauaaggaacgacgaggaguugaacaagcuguugucgggagucaccaucgcucaaggcggaguacuucccaacauccaggccguucugcugccgaagaagacagagaagag

SEQ ID NO: 823 - RNA, 760 nt, piezodorus guildinii
uacucgacacaguuucgaucgagaugaaccgaaucgugaaaaagaaguuuauuuaacaguucgagcuaccgauaauggaaggccacagcuugaugaugucuguacauuuaaaauuauuauugaagauauuaaugauaacccuccaguauuugauaaaguugacuaccaagaauccguaccucaagauuuaccaccuaaacgugaaguaaugagaauaucugcuacugauguugaugauggaaacaacaguauuguaauguacaguuuagaaccaagaucugcagaucuaaguacuaaaagcuauuuucaaauugacaguaaaaccgguguuaucacccuugaucgagcgauugaucgugauccugguuauaaauuuaaacucagggcuacagccacagaucauggagauaucccuaaaucugcaguuauuaaccuagacauucaaguaguugagucuaauaagaaagcuccaguuuucacaucaauaccugccucaccuauuguucuucuggaaaauuucacugacuucacugaaaauauugcuacuuuaaccgcuaugucuaaugaugaaaaagcuccuguuuuugaauuaguuacuggaagaacugagcagaccaauaaauauaguacauuucgguuagagucugaugcaaacacugcucauauuaggcuugccaggcggauggauuaugaaucgauugcagaauauacacucacaauucgaauacagaacaaauucaaucuggcuucugagacuagu

SEQ ID NO: 824 - RNA, 720 nt, piezodorus guildinii
agccucaaaagaagacugagcguagacaaucugaaaagggcgauggagauccagaauucguuaaacgccaggaggcuaaaacaucagcuuuggaugaacaacucaaggauuacauagcagaauggagaaaacaaagggcgaaagaggaagaggaccuaaagcgccucaaagaaaagcaagccaagagaaaggucaugagagcugaagaagaaaagagacucgcagaaaagaaaaagcaagaggaagaaaggcgagucagagaagcugaagaaaagaaacagagagacauugaagaaaagaggcgucgacuugaggaagcagaaaaaaaacgacaggcaaugauggcagcucuuaaggaucaaaguaaaagcaaggguccaaacuucacaaucagcaaaaaggaagcuggucuaaacuugucuucagcacaaauagaaaggaacaaaacaaaggaacaauuagaagaagaaaaacguaucucccuuaguauaaggauuaaaccauuaaauauugaaaaucuaaacauugacagauuacgauuaaaagcuauugaacucugggauugcauuguaaaacuggaaacugagaaguaugaucuugaggaaaggcaaaaacgucaagauuaugaucuuaaagaacugaaggaaagacaaaagcagcaacugaggcacaaagcacugaagaaagguuuagauccagaggcuuugacuggcaaauauc

SEQ ID NO: 825 - RNA, 750 nt, piezodorus guildinii
ucaagaagaagaugcaagcuaugaagcuugagaaggacaacgcgauggaccgcgcccuccugugcgagcagcaggccagggaugccaaccugagggcggagaaggcugaagaggaggcgagguccuugcagaagaagauccaagccaucgagaacgacuuggaccagacgcaggaacagcugaugcaggucuugcagaagcuugaggagaaggacaaggcucuccagaacgcugagagugagguugccgcccucaacagacguauccaacuguuggaggaggaccucgagaggucugaggaaagauuggccaccgcaacagccaaguuggccgaagccucccaagcagcagaugaguccgaaaggcagagaaagguucuugaaaaccgcagcuuggcugaugaagagcguauggacgcccuugaaaaucagcugaaagaagccagauuucuggcugaagaagcugauaagaaauaugaugaggucgcccguaaauuggccaugguugaggcugauuuggagagagcagaagaaagagccgagaguggugaaucgaaaauuguagagcuugaagaagaacuucgcguaguugguaauaacuugaaaucacuggaagugucagaagaaaaggcaaaccagagagaagaagaauacaagaaccaaauuaagacccuuacaaacagacuuaaggaggcugaagcucgugcugaauuugcugaacguuccguucagaaauugcagaaggaagucg

SEQ ID NO: 826 - RNA, 748 nt, piezodorus guildinii
aaauaaggggcucuccaaaggaggaaagaagggaguuaaaaagaagguaguugacccuuuuacaaggaaagauugguaugauguuaaggccccaucuauguucaacacccgucaaaucgggaagacccuugucaacagaacucaaggaacuaaaauugcuucugagggacucaaaggucgaguauuugaagugagcuuagcugaucuucagaacgauacugaugccgaaaggucauucagaaaauuccgccucaucgcugaagauguucaaggcaggaauguuuugaccaacuuccaugguauggacuugaccacagauaaacuaaggagcauggucaaaaaguggcagacuuugauugaagccaauguugaugugagaaccacugacggcuacuuguuaagaguuuucugcauuggauucacuaacaaggaccagaugucccagcguaaaacuuguuaugcccaacauaaucagguucgagccauuaggaaaaaaaugguugauaacauuaccaauaacauuaguaacagcgauuuaaggguuguuguuaacaagcucauccccgauucgauagcaaaagauauagaaaaaauaugccaaggcaucuauccccuucaugaugucuauauuaggaaggucaaaguauugaagaaaccaagguuugaguugagcaaacuucucgaacugcacggugauggcaaaggcuccgacgaaccugguucaaagguuucaaggccugaagcuuau

SEQ ID NO: 827 - RNA, 581 nt, piezodorus guildinii
gcuacugcaaaaacaaaccuuaccccaagucaagguuuugucguggugugccugauccuaagaucaggauuuuugaucuuggaaagaaaaaggcucguguagaugauuucccauuauguguacaucuugugucugaugaauaugaacaacuuucaucagaagcacuugaagcaggacguaucugcgccaauaaauaucuagugaaaaauugugguaaagaucaguuccauauuagaaugagauugcauccuuuccaugucaucaggauuaacaaaauguuaucgugugcuggagcugauaggcuccagacugggaugagaggagcuuuuggaaaaccacaagguacuguggcuagaguacacauuggucagcccaucaugagcguccguuccagugacagguacaaggcugcugucauugaggcacucaggagggccaaguucaaguucccaggaaggcagaagaucuauguuuccaagaaaugggguuucaccaaguaugacagagagacauuugaggaacugcgugcagaugggaaguuggcaaacgaugguugcaaugugaaguacaggagggaucau

SEQ ID NO: 828 - RNA, 620 nt, piezodorus guildinii
agagaacuugcugaagaagguuacucagguguugaaguucgagaaacuccaagcagaacugaaaucaucaucauggcaacaagaacucagaguguacuuggugaaaaaggacgacgcauccgagaauuaaccuccguagugcaaaagcguuuuaauuuucaaccacaaucauuagauuuauaugcugaaaaaguaccuacgagagguuuaugugcuauugcucaagcugagucuuugagguacaaacugauuggaggucuugcgguccgaagagcuuguuacggaguauugagauucauaauggaaaauggagccaaggguugugagguuguaguuucaggaaaacugagaggccaaagagcuaaauccaugaaguucguugauggacucaugauccacaguggugaccccuguaaugaguacgugaacucagcaacccgucacguauuauugagacaagguguacuuggcauuaaagucaaaauuaugcugccaugggacccaaccggaaagaauggaccuaagaauccucugccugacaaugucuguguugucaacccuaaagaugaaguuauuccuucagacauuaagacuaugggaauugaacuacauccuccagc

SEQ ID NO: 829 - RNA, 161 nt, piezodorus guildinii
gcuuguguauacucugcacucauccuugcugaugaugauguugccguaacuggagagaaaauccaaaccauccuuaaagcagcagguguugauguugaacccuacuggccuggccucuucgcuaaggcccucgaagguaucaaugucaaggaccucaucac

SEQ ID NO: 830 - RNA, 582 nt, piezodorus guildinii
aaagaagaaaaagcacccacagcuucugaagcaauacaaaagcuucgcgaaacugaggauauguuaauuaaaaaacaagauuuuuuggaaaagaaaaucgaaucugagcuaagucucgugaagaaaaauggaacuaguaauagaagaguugcaauccaagcacucaaaagaaaaaagagguaugagaaacaguuacaacaaauugaugguacuuuggcuacaauugaaaugcaaagagaagcuuuagaaggugcuaauacuaauacggcuguacuucaaacaaugaaauuugcugcugaugcauuaaaaacugcccauaaacauauggauguugaccaaguucaugauaugauggaugaaaucgcugagcaacaagauguugcaaaagaaauaucggaagcuauuucuaacccugucgcuuuuggaaaugacauugaugaggaggaacuugaaaaggagcuugaagaauuagaacaagaagaguuagacagggaacuucuuggaacuggucccacugcugaucaauuaccugauguuccugcuacucaguugccagccaaaccaaagccaauugcaucagaa

SEQ ID NO: 831 - RNA, 375 nt, piezodorus guildinii
uaucgaagaagugucccaacaugguugaaauuaucacccgaagauguuaaggaacaaaucuacaaauuaggaaagaagggccucacuccuucacaaauaggugucauucuucgagauucacaugguguggcccaaguacgauuuguaacuggaaacaagauucuucgaaucaugaaggccaugggauuagcuccugaucuuccagaagaucuguacuuucuuauuaagaaagccgucgcuaucagaaagcaucuugagaggaacaggaaagauaaggauuccaaguuccgucuuaucuugguugaguccaggauucacaggcuugcucgcuacuacaaaaccaagggcggacucccaccuaacuggaaguacgag

SEQ ID NO: 832 - RNA, 705 nt, piezodorus guildinii
uaucaaggccuggucugauauucagaaggucuacaaaucuaaaagauuccgugcugguaaagguaagaugcguaauaggagacgcauucagcguagaggaccacucaucaucuaugggcaagaucaaggucuaacucgugcuuuccguaacauuccugguguugaucuuaucaacguuucacgguugaacuugcuuaagcuggcaccugguggucauguuggaagguuugugaucuggacccaaucagcuuuugaucaacuuaacgcucucuauggcacauggaagaaaaaaucaacuuugaaaaaggacuacaacuugccuaugcccaagaugguuaauacugaccugucuaggcuguucaagucugaagaaaucaagaguguccuuaaagcaccaaggaagaccauaguuaggaggguuaggaaacuaaacccauugaggaacacucgagcaaugcucaagcucaauccauucgcugcaguucugaagaggaaagccauacuugcugauaggaaacuuaagcuugagagggcuauugagagaucaaagaaggaaggaauugagcuuaccccucaucaaaagagguauguugcuaugcucgagcgaaggaaagcucagaucaaagcugcuaaggcugcuaagccuaaaaaggucaagaaaccaaaagcugaaaaaacugaagcugcugaagcaaagaaagcuag

SEQ ID NO: 833 - RNA, 600 nt, piezodorus guildinii
guuaaaaucgcaaaggccuuggcauaaaguguucucguguagugcuuucaggaacccuuccauuuuaagugaaaugacgggguuuucggacaagcccaucuuaauugauggcaaaggucacuuacugggucggcuugcagcuauaguggcuaaagcugccuugaauggcaacaggauaguuguuguuaggacugaacaaauuaauauuucaggaaacuuuuucaggaguaaacuuaaguauuugucauucuuaagaaaaagauguaauguuaauccagccagagguccuuuucacuuccgggcacccagcaaaauuuuguaucgaacuaucagaggaauggugccacacaaaaucgaaagggggaaggcugcuuugaggcguaucaaguuguuugagggaaucccuccccccuaugauaagaggaaacgaguaguuguuccgacagcuaugagaguauugugcuugaaaccugguagggcuuauugccaucuugguagguugucuucugaaguugguuggaaguacaaggauguagugagagcucuugaaaccaagaggaaagucagggcaguuuuugauauucgcaagagaaauucccu

SEQ ID NO: 834 - RNA, 795 nt, piezodorus guildinii
uucaacaacagccacaaaucaggcaacaacaacaauuuagcauuucgccguuguuaauggcucagcggaaaaugcuuaaccauaaucagcagaugcaacagaagcagagacuucuccaguugcagcaacagcaacagcuugugauuccaucuaaugcuacugcccaaaaugcugaccccgcgcuccacaauauugauagccuuaucaauaauacgguugcuccgaacguaucucuucagagaucaagcagcguucccgauucucagcuguccccuguuggaaguuacccuggccuaggaucuguaccaucaccaggacagagaaggccuuucucaccugucaacggggggaugacgaguuucucgagcggugguggcgcgggcccccccgugucaggaaguggcccccaagccagacuuucccccagcucccuccaaggauaccagcaacaaccccagcugucuccaaggcucacucagggccagcaaaacuaugguggcgguggugcuagcuggucucagcagaauucucggcuuucugugcagcaacaggaaaacccuguccucaaugcucaauugacgagcggaggacgaggauacgcuaggaauacuucagccggguuacccccugugaggucacuggcuggcccacagcgauuccccaccgcggcugaccaacaggcuggugcugcuucauaccaauuccggcugcagcgccaggugucagcaccuccaccucaacaaucaucacccaacccacaguuaccaggugguaauaauggcgugacagaguaug

SEQ ID NO: 835 - RNA, 503 nt, piezodorus guildinii
aauauuguuagggcggacugguaacaacaacguggguuucuuugagguucuucacgaaucgucggugcgucggauuaucaauuucauccgaauucaucaauccaaaauggggaagauuaugaaagcugguaaggugguguuggugcugagugguagguaugcaggaagaaaagccauaguucuuaaaacuugugaugaaggaacacaagagaaggcuuaugggcaugccauaguugcuggcauugaucgcuacccccguaaaguucacaaaaggaugagcaaaacuaagauccacaagaggucuaagaucaagcccuuuuugaagguuaugaacuacaaccaccuuaugcccacucguuacacaguaucugagaucgcuccugaccaaaagguagugacaaaagauuugaaggacccaaugaagaaaaagaagauccguuuccaaguuagggugaaauucgaagaaagguacaaacaaggcaagagcaagugguuuuucgaaa

SEQ ID NO: 836 - RNA, 550 nt, piezodorus guildinii
aaauaagaaaaagggcgcugcugccccugagaagaaaaaaucccucaaaaaggaaccuaaggacaagucaaaaaauguuaugaaagaagucagaauccgaaaacucugccugaauauuuguguuggagaaucuggcgauaggcugacaagagcugcuaagguguuggagcaguugacuggacagcaaccugucuuuucuaaagcuagguauacuguaaggucuuuuggaauccguaggaaugaaaaaauugcuguucauuguacaguucgaggagccaaagcagaagaaauuuuggaaagaggauuaaagguccgggaauaugaacugagaagggauaacuucucugacaccggcaauuuuggauuugguauucaggaacacauugauuugggaaucaaguacgaucccaguauugguaucuaugguuuggacuucuacguuguucuuggacggccagguuucaauguugcccaccggcgaaggaagacugguguaguugguuuccaacauagguuaacaaaagaagaugcgaugaaaugguuccaacag

SEQ ID NO: 837 - RNA, 734 nt, piezodorus guildinii
uguacagagguaagaggaggaaugaagucccaccucacaucuuugccaucucugacggugccuacguaaacauguugacaaacaaggagaaccagucuauguugauuacuggugagucuggugccggaaagacugaaaacacgaagaaaguaauugcguacuucgccacuguuggugccagcacaaagaaagaugaagcauccgaaaagaaggguacccuagaagaucaagucguacaaacuaaccccguacuagaagccuucgguaaugccaagacaguccguaacgauaacucuucucguuucgguaaguucauccguauccacuucggaccaucaggaaaacuggccggagcugauauugagaccuaucuacuggagaaggcucgugucaucucccaacagacccuggaaagauccuaccacauuuucuaccagaucaugucuggugccgucaagggagucaaggccaagugcuugcuuucugacgacauuuacgaguacaacuucaucucccaggguaaagucacuauugcagguguagacgaugcagaggaauuucaacugacagacgaagccuucaacgucuuggguuucacccaacaagagaaggaugacaucuacaagaucaccgcugccguuaugcacauggguugcaugaaguucaagcagaggggucgcgaagaacaggcugaagccgauggugucgaagaagguaucagggucgguaaacuc

SEQ ID NO: 838 - RNA, 668 nt, piezodorus guildinii
ggaacaggguaugaucugucagcaucacaguuuucuccugaugggaggguuuuucaaguugaauaugcacaaaaggcuauugaaaacagugggacuguuauuggucugagagguaaagaugguguuguuuuagcagucgaaaaauuagucacaucaaaacuauaugaaccgggugccaauaagagacuguuuacuauugacaaacauauuggaauggcuguagccggauuaauaucagaugcaagggcaguugcagaaguggcuaggacagaagcugcaaauuacagaucucaauauaagagcaguauaccucuuaaguacuugaaugagcgagugucuauguacaugcaugcuuauacccucuacagugcugugaggccauuuggaugcaguguaauacucaguacuuacacggaagaggacggcccagaaauguauaugauagacccaucaggaguuucauaugguuauuuugguugcgcuguuggaaaggcaaaacaggcugcaaaaacugaaauagaaaagcuaaaacucaaagaaaugucaugucaggagcucguaaaagaagcagcacgaauuauuuaccucguccaugaugagcugaaggacaaacaguuugagcuugaaaugaguuggauuggcucucacacgaaugguguaagucaaca

SEQ ID NO: 839 - RNA, 710 nt, piezodorus guildinii
augguugaaacaucugugguuacuccugcagcuccugcugccaauaagaaagcagggucaaccagaaagccucagaggagaaauuacaaccucgguucaggaguuuauagguucagcagaacucgcauguuccauaagaaggcucuauggaaauuuauugguaagaaaacaccuaagacuccccguccuaaaaggaaaacuacucuugaaaaaaagauugguggugagaaaaauggaggcacucguacugucuauuuaaagaaaaggacuaaaucauauccuacagcuaacaaggugaggaaacacccaaguaaaaccuauuuuugucagcacaagagaagguuccgugccucccuaaaaccugguuccauugucauucugcuugcugggcuucacaaaggaaaaagggcaguucuuuuaaaaaauaugccuagugggcuucuuuugguuuccggaccauacacccugaauggaguaccucuuaggagaauacauccuaacuauguuauugccaccucgacucagaucgauuuguccggaguuaaguuaccugagcauaugaaugauaaauauuucaagaggguuaaagcuaaaaaggccaagaagagugauggugaaaucuuugcugcuaaaaaagaacucuacaaaccaucugaacagaggaagaccgaccagaaggagguggacaaacaaguuuugcaggccauuaa

SEQ ID NO: 840 - RNA, 652 nt, piezodorus guildinii
ccaaagacaaauuggccauuuucccuucucgaggagcucagacuuugaugaaaggaagacuugugggcgcucaaaaaggucacaguuuguuaaagaaaaaagcagaugcccuacaaauuagguuuaggaugauccucagcaaaauaauugagacaaaaacgcuuaugggagagguuaugaaagaagccgcuuuuucauuagcugaagcuaaguucgcuacuggagauuucaaccaacaaguuuuacaaaauguucagaaagcucaaauuaaaauaagaacaaagaaggauaacguugcaggugugacacuacccguuuucgaaagcuaucaagacggaacagauucuuacgaguuggccggacuggcuagaggugggcagcaguuggcaaaacugaagaagaacuaucagaaagcuauuaaauugcucguagagcuggcuucauugcagacuucuuuuguuacguuagaugagguuauuaagcuuaccaauagaagaguuaaugcuauugaacacguuauuauaccaagaauugaacgcacacuucaauauauuauuucugaauuggaugaguuggaaagagaagaauucuacagauuaaaaaagauucaagauaagaagcguaucgcccgucaaaaagcagaagcgaagaa

SEQ ID NO: 841 - RNA, 576 nt, piezodorus guildinii
ucaaucaaccagcucguaaauaucgccgaagaaugaagagaguaaagaaagcuagagcucuggcucccagaccagcaacacuuuuacguccugcagucaggugcccaacugugcgcuaucauacuaaauugagaccuggcagaggcuucacauuggaagaaauuaagaggguuggauuaugcccuggauucgcaagaucuaucgggauugcagucgaucauaggagaagaaacaagucggucgaaucuuuacaguugaauguacaacgccuaaaagaauaucaagcuaagcugauccuguucccauccaagaagagcaagaaggugaagaagggagaagcuucggcggaagaacaggcuuuagcugcccaaguuucuucaccuguuaugccaaucaagcagaccguuguaaagaugaaagccagaacaauuacuccugaggacaagagcuucucugcuuaugcagcuuuaagaaaggcaagggcagaugaaagacuaguaggaaucagagcuaagaggcugaaggaagcugcugauaauccugaaacuguugagaaggcugcaaaacagaagaaaa

SEQ ID NO: 842 - RNA, 529 nt, piezodorus guildinii
uguuugcagcagguuauagugcuacuacuacacgucauuuuauguaauuuagauauggauggguuacuauuggaaccuacucuuuacacugugaagggaaugguaauuuuggacaaugaugggcaccgaauacuagcuaaguauuaugauccaaguguguuuccaacuucuaaggagcaaaaggcauuugaaaaaaauuuguucaacaagacccaucgggcuaaugcagaaauaaucauguuggaugggcuuacauguguuuauaaaucaaauguugauuuauuuuuuuauguuaugggaaguucgcaugaaaaugaguugauauuaaugagugugcuccagugccuuuaugauucuauuagucaaauauugaggaaaaauguagagaagcgaacucuguuagaaaauuuagaaauuguaauguuagcaauggaugaaauaugugauggaggaauaauauuagaggcagacccaacaaguguuguacaaggaguagcuuugaggacagaugauaucccacuuggugaac

SEQ ID NO: 843 - RNA, 483 nt, piezodorus guildinii
ccuguuuggcaaaaaggaaaugagaauauugaugguuggucuugaugcugcuggaaaaacaacuauuuuauauaaauugaaauuaggagaaauuguaacuacaaucccaacuauuggauuuaauguugaaacuguugaauauaagaauauuaguuucacaguuugggauguagguggucaagacaaaauucgaccccuuuggcggcauuauuuccaaaauacucaggggcucauuuuuguuguagacaguaacgauagggaacguauuggugaagcgagggaagagcugaugagaaugcuugcagaagaugaauuaagagaugcaguucugcuaauuuucgcaaacaagcaggacuugccaaacgcuaugaacgcagcugagauaacagacaagcugggccuacacucauugcgcaaucgcaacugguacauccaggcgacgugcgcgaccucaggcgauggucucuacgaaggccuagauug

SEQ ID NO: 844 - RNA, 368 nt, piezodorus guildinii
acgaaguuaaucccaaagcuuacccauuagcugaugccacccucacugcuaagauauuaaauguugugcagcaagcucucaacuauaagcaguuaaggaaaggugcuaaugaaucuacaaaaacuuugaaucgggguuuggccgaguucauagugauggcugcggaugcagaaccauuggaaauauuguugcaucuuccucuguuaugugaagacaagaaugugccauauguuuuuguccgcuccaagcaagcucuugggagagcguguggagugucccgcccggucgucgccugcucggugacgcucaacgaaggaucucagcucaagccgcagauaacgaaaauacaacaagacauugagaggcuu

SEQ ID NO: 845 - RNA, 700 nt, piezodorus guildinii
ggagaaggaggaagaaaaggauauuaaaucucuugaugaagcugauaucgcuuuacuuaaaacuuauggacaagggcaauacacgaaaagcaucaaaagugucgaagaugauauucagaccauuaucaaacgugucaaugagcugacagguauuaaggaaucagauacugguuuagcuccuccugcguuaugggacuuggcugcagauaagcagauacuucaaaaugaacagccguuacagguugcuagauguacaaaaauuaucaaugcugauuccgaagauccaaaauacauaauaaaugucaaacaguuugcaaaauuuguaguugacuuagcugauucuguagcaccuacagauauugaagaagggaugcguguuggugucgauagaaauaaauaucaaauucagauaccucuuccaccaaaaauagauccaacuguaacaaugaugcagguugaggaaaaaccggaugucacuuauagugauguuggugguuguaaugaacaaauugaaaaauugagagaaguuguugagacuccuuuguuacagccugaaaaguucgugaauuuaggaauagagccaccaaaaggaguucuucuuuuuggaccuccugguacaggaaaaacacuuugugcgagagcuguugcuaacagaacugaugccuguuuuaucagaguaauugguucagaacuuguccaa

SEQ ID NO: 846 - RNA, 368 nt, piezodorus guildinii
acgucauuuuacugcuccaucucauauuagaaggaaauugaugucagcuccucucuccaaggaacucaggcagaaguacaauguccgcaccaugccuguuaggaaagaugaugaaguucaaguaguuaggggacauuauaaaggacaacagguaggcaaaguuauucaggucuacagaaagaaguuuguuauauacauugaaagaauucaaagagaaaaagcaaauggugcaagugucuauguuggcauccauccuuccaaaacaguuauagugaaacugaaaauugacaaagauaggaaagaaauuuuggauagaagaucaagaggaagagcccuagcccuuggcaaagacaaaggaaaguacaccg

SEQ ID NO: 847 - RNA, 755 nt, piezodorus guildinii
aacgcucucgcuaauauguuaguugcacaacagaaugaagaguauucacuuauaaaggcuaaagaaaagucuguucauacuauccaaguugaugauccuguaucauuuuuacaauuaucaacaaugcgaucaucugauuuugguucugaaaauguuuuugagcuuagucuaaaucaagcuguuggaggaccuaauacagcugcaaacacaaccgagcuuccauuuucugccaguaaauugaauaaaguaacucaacuaacuggauuuucagauccuguuuaugcugaagccuauguucacgucaaucaguaugauauaguacucgauguuuugauuguuaaucaaacaggcgauacacuacaaaacuguacacuugaacuggcaacucuuggugaucugaaacuugucgaaaaaccucagccuuguguucuggcuccuuaugauuucuguaauauuaaagcaaauguaaaaguugcaucuacugaaaauggaaucauauuuggcaauauuguuuaugauaucaguggugcugcuucugacagaaauguugucguucuuaaugauauccauauagauaucauggauuauauuguuccugcuacuuguucagauacagaauuccgucagaugugggcugaauuugaaugggaaaacaaagugucuguuaauacguauuugguugaucuucaugaauaucuuggacauuuauuaaagagcaccaauaugaaauguuuaacuccagaaaaagcucucug

SEQ ID NO: 848 - RNA, 434 nt, piezodorus guildinii
uugaaacgggaagaauagcauauauugcugauggaccuuaccagggcaaguuaugugcuauuguggauguaaucaaucagaccagggcuuuaguugaugggccagaaacuggaguaccaagaugugguauaagguuaaaccaauugcaucuuacaaaguucaggauucguuucccuuacaccgcuucuacacgcguuguccgaaaagcuuggaaagacagcaauuuggaugccaaguggaaggagaguguuugggccaagaaguuggaagccaaaaaaaucagagcaaauaugaaugacuucgacagguuccgccuuaacaaugccaggagaaccaggagcaagaucacuaccaaugccuucauguuguugaaaaaacaagcaaagaaggccaagaaaaccgaagccaagccuggacagaagccuaaggacaaa

SEQ ID NO: 849 - RNA, 800 nt, piezodorus guildinii
ggaaacccugacguaucuacuuuguuuugcuuugcaguucguacaccgacaggaggaaagcuucauauaauugagguuggacagccccccucaggaaaccagccauucgcuaaaaaagcaguugauguauuuuuuccgguagaagcccaaaaugauuuuccaguugcuaugcagguuagcucuaaguaugauguaaucuaucuaauaacaaaguauggauauauucaucuguaugauuuggaaacagcuacaugcauuuacaugaaucguauuagcauugauacuauauuugucacugcaccucaugaaucaacuggagguaucauuggggugaauagaaaaggccagguguuaucagugaguguugaagaggaccacauaaucccauauaucaauaauauauuacaaaauccagaucuagccuuacgcauggcaguuagaaauaaucuagcuggagcugaagauuuguuuguuaaaaaauucaauaugcuuuuccagaaugggcaguaugcugaggcugcuaaaguggcagccaaugcucccaagggaauacugagaaccccacaaaccauucagcaguuccaacaaauaccaaauccgcaagggcaaacaucaccucuuuugcaauauuuuggaauuuugcuugaucagggucaauugaacaaguaugaauccuuagaauuaugcagaccuguucuggcucaaggaagaaaacaguuaauggaaaaauggcugaaagaagauaaacuagagugcucugaagaacucggagaucuaguaaaacaaacagacccaacucu

SEQ ID NO: 850 - RNA, 438 nt, piezodorus guildinii
cucacggguaagaccauuacccuugaggucgagccuucugauacuauugaaaaugugaaagcuaaaauucaagauaaggaagguauuccuccugaucagcagcguuugauuuucgcuggcaaacaguuggaagauggcagaacucugucugacuacaacauucagaaagaaucuaccuugcacuuagugcuaaggcuuaggggaggugcaaagaaacguaagaagaagaauuacuccacucccaagaagaucaagcacaagaagaagaaggucaaacuagcugugcuuaaauauuacaagguugaugagaaugguaaaaucagcagguugaggagggagugucccucugaacagugcggugcuggugucuucauggcugccauggaggacaggcacuacuguggaaagugugcauacacccuugucuucaauaagccu

SEQ ID NO: 851 - RNA, 518 nt, piezodorus guildinii
augaaaaggcucgucuagaccaggaguugaggauuauuggagaauaugggcuuagaaacaagcgugaaguauggagggucaaauauacccuugcuaaaaucaggaaagcugcccgagaacuucuuacucuugaugagaaggauccuaagagguuguucgaagguaaugcacuuuugaggagauuaguaagaauuggaguauuagaugaggcuaagaugaaacuugauuacguuuugggucuuaaaguugaagauuucuuggaaaggaggcuucagacucagguuuucaaauugggucuugcuaaaucaauucaccaugcuaggguuuugauuaggcagaggcacauuagagugaggaagcagguugucaacauccccagcuuuauugugagguuggacucacagaaacacauugacuucucacugaagucuccauucggugguggccgcccuggccguguaaagaggaagaacucccgcaagggaaccaccgcugccgcugcagaagaagacgaagau

SEQ ID NO: 852 - RNA, 774 nt, piezodorus guildinii
cuuagccacugagagaacucuuccuggguuuucuuuugaaaauugucgaaggaacucccucuuguugcagcaaggauuuaaaccgcccacugcgcagaagacugguacaacaauuguuggaauaauuuauagagaugggguuauucuuggagcugauacuagagcuacagaagguagcacaguugcugacaagaauuguuccaagauacauuuucuagcugacaacauuuauugcuguggugcugguacugcugcugauacagaaaugacgaccaugacaaucaugucacaauuggaauuacaucgucucaauacuggucgcccugucagaguuucuacagcaaagcagcuuuugaaacaguuacucuucagguaucagggccacauuggagcagcucuuguuguugguggggucgaugugacuggaccucuucuuuauucuauacauccucauggcuccucagaaugcuuacccuucacaacuauggguucugggucucuugcugcuaugacaguacuugagucaucauggaagccugauuuaucugaagaagaagguaaaguaauaguccgcaaugcuauugcugcuggaauauuuaaugaucuugguucagggagcaauguagacauuuguaucauccggaaagguucuguugauuauauccgucccuuugauguugccaaucucaaaggacaaaagcaaaauaauuaucguuuucggcgaggaacuacgggaguucuuucaacaaggauaauuccuuuggugacagaguc

SEQ ID NO: 853 - RNA, 720 nt, piezodorus guildinii
agagcaaggauagugacucucaccagguuauuguacuuuugcuugguaaucauggguucugagagauacaguuuuucucugacuacauuuaguccuucugggaaauuaguucaaauugaguaugcucuugcugcagucgcagcuggagcuccaucaauugguaucagagcaucuaaugggguuguauuggcuacugaaaacaaauacaaaucaauuuuauaugaagaacauacuauucaaaaaguagaaaugauaacuaagcacauaggaauggucuacagugguaugggaccugauuauagauuacuuguuaagagagcaagaaaaauggcgcagcaauaucaguuaguuuauggcgagccuauuccuaccgcacaacuuguccaacgaguagcuaugguuaugcaggaguacacucagucaggaggugugagaccguuuggaguuucuuuacucaucgcuggcugggauggagauaaaccuucucuauuucagugugauccaucuggagcauacuuugccuggaaagcgacugcuaugggaaagaauuuuguuacaggcaaaacuuuucuagaaaagagguacagugaaacuuuggagcuagaugaugcaguacauacggcaauucuuacucucaaggaaaacuucgaaggacaaaugacuucggacaauaucgagguuggaguuugcgaugcccaaggcuucagaguuuuagaccca

SEQ ID NO: 854 - RNA, 707 nt, piezodorus guildinii
ccaguucugcuaagccagcuucagccaagcaacccgccccagcuccuaaagcugcacagccuaaagcccaggcuaagccugcagcucaacaacagaaaccagcuaaaccacaacagcaagggaaagcugcagccccagcgaaagcacaagcuaaaccugcagcgcaggccaagccugcugcuccagccgcagcucccaaacaaccagccgcuccagcagcagcagcuggaacccaaccagccgcugcagcacccaagaaagcuccaucaggugcaguuaagaaagcagcaacugccccuaagaaaagucaaaauuuacagaaaaaaucucaccaagguguuaggaaacaaguguuaaaaggaaaaggacaaaaaaagaaaaaagucucauuaaaguuuauaauugacuguacucaucccuaugaggacaaaaucauggaugucgccaacuuugaaaaguauauucaggagagguuuaaaguuaaugguaaaaccaacaacuuaggcaacaauguuacuuuagaaaggaacaagaugaagauaacuguuacuucugauguacauuuucccaaaagguauuugaaauauuugacuaagagguaccuuaagaagaacaaucugagggauuggcucaggguuguaucaaguucuaaagacaccuaugaacuaagguacuuccaguucaacagccaggaugaugaugaugaa

SEQ ID NO: 855 - RNA, 261 nt, piezodorus guildinii
aaggaggaauggaggaagaucaaaacauggcaggggucauguccaagcagugcguuguaccaacugugcucguuguguuccuaaggauaaggcuauuaagaaauuuguuauucguaacauaguugaagcugcugcugugagggauaucacagacgcuagcguauacuccucauaccaauugccgaagcucuaugcuaaacugcauuauuguguaucaugcgcuauccacucuaaaguagugcguaaucguucuaaggcuga

SEQ ID NO: 856 - RNA, 717 nt, piezodorus guildinii
cgacgagaagguaaaacagauuauuaugccaggaagagauuaauuguacaggauaaaaauaaguacaauacuccuaaauaucguuugauuguccgccuuuccaacaaagacauaacaugucagguugcuuauucucgcauugaaggugauaaaauauugugugcugcauacagccaugaacuuccucauuuuggaauuaaaguaggauuaaccaacuaugcugcugccuacuguacuggucuucuuuuggcaaggaggcuucuucaaaaacugaaguuggaugguuuguaugaagguacaaccgaaguaacaggugaugaguacaauguagagaauuuagaugaagguccaggugcuuuccgcuguuacuuagauguugguuuaaugaagaccagugcuggagcccguguuuuuggagcacugaaaggugccguugauggaggucuuaacaucccucauagcaugaaaagauuuccagguuaugauucugaaagcaaagaguucaaugcugaagugcacagaaaacacauuuuuggaauucacguugcugaauauaugaggcaguuguccgaaucugacgaagaagcuuauaagaagcaguucaguguuuacaucaaaaauggcauuguuccugaugcuauugaagacauuuacaagaaggcacaugcugcaaucagggaaaauccugccccaagaccacguguaaggaguaaggag

SEQ ID NO: 857 - RNA, 453 nt, piezodorus guildinii
caccggcaaaacaauaacauuagaaguugagccuucagacacaaucgaaaaugugaaagcuaagauccaagauaaagaaggaauuccuccagaucagcagagguugauuuuugcuggaaagcagcucgaagauggccguacucuuucagauuauaacauucagaaagaaucuacucuucaucuaguacuucguuugagaggagguaugcagaucuuugugaagacacucacuggcaaaacaauaacauuagaaguugagccuucagacacaaucgaaaaugugaaagcuaagauccaagauaaagaaggaauuccuccagaucagcagagguugauuuuugcuggaaagcagcucgaagauggccguacucuuucagauuacaacauccagaaggaaucuacguuacaucuaguccuucgucugcgaggugguaugcagauuuuuguaaaaac

SEQ ID NO: 858 - RNA, 537 nt, piezodorus guildinii
ggauggaggaggccucaagaggcaagaaggccaagaaagguuucaugacgccagacaggaagaagaaacuccgacuucugcugagaaagaaagcugcugaagaacugaagaaagaacaggaaaggaaagcagccgagagaaggaggaucauugaggagcgcuguggaaagauuugugacguugacaacgccagugaagaaaaauugaagaaaaucugcucugauuaccaccagcgaauuggacgguuggaggaugaaaaauuugacuuggaauacguuguaaaaaagaaagauuuugagauugcggaucuuaacagccaagucaaugaucuucguggaaaguucguuaaacccaccuugaaaaagguuuccaaauaugaaaauaaauuugccaaacuucagaagaaggcugcugaauucaacuucagaaaucaacucaaaguugugaagaagaaggaauuuacccuagaagaagaagacaaagagaaaaaaggaggcaucgucgacugguccaagaaggaugaaaaggcaaagguag

What is claimed is:

1. An interfering ribonucleic acid (RNA) molecule wherein the RNA comprises at least one dsRNA wherein the dsRNA is a region of double-stranded RNA comprising annealed complementary strands, one strand of which comprises a sequence of at least 30 contiguous nucleotides which is complementary to a target nucleotide sequence within a stink bug target gene, and (i) comprises at least a 30 contiguous nucleotide fragment of a sequence according to SEQ ID NO: 242, 296, or the complement thereof; or (ii) comprises at least a 30 contiguous nucleotide fragment of a nucleotide sequence encoding an amino acid sequence encoded by a sequence according to SEQ ID NO: 242, 296, or the complement thereof, wherein the interfering RNA molecule has insecticidal activity on a hemipteran plant pest.

2. The interfering RNA molecule of claim 1, wherein said hemipteran plant pest is a stink bug.

3. The interfering RNA molecule of claim 1, wherein the RNA comprises at least two dsRNAs, wherein each dsRNA comprises a sequence of nucleotides which is at least partially complementary to a target nucleotide sequence within the target gene.

4. The interfering RNA molecule of claim 1, wherein the interfering RNA molecule comprises SEQ ID NO: 242, 296, or the complement thereof.

5. The interfering RNA molecule of claim 1, wherein the stink bug is selected from the group consisting of *Euschistus heros, Nezara viridula, Piezodorus guildinii, Halyomorpha halys, Chinavia hiare, Euschistus servus, Dichelops melacanthus, Dichelops furcatus, Edessa meditabunda, Thyanta perditor, Chinavia marginatum, Horcias nobilellus, Taedia stigmosa, Dysdercus peruvianus, Neomegalotomus parvus, Leptoglossus zonatus*, and *Niesthrea sidea*.

6. A nucleic acid construct comprising the interfering RNA molecule of claim 1.

7. A nucleic acid molecule encoding the interfering RNA molecule of claim 1.

8. A recombinant vector comprising a regulatory sequence operably linked to a nucleotide sequence that encodes the interfering RNA molecule of claim 1.

9. A composition comprising two or more of the interfering RNA molecules of claim 1.

10. An insecticidal composition for inhibiting the expression of a stink bug target gene, comprising the interfering RNA of claim 1 and an agriculturally acceptable earner.

11. A transgenic plant, or part thereof, comprising the interfering RNA molecule, the nucleic acid molecule, the nucleic acid construct, and/or the composition of claim 1, wherein the transgenic plant has enhanced resistance to a stink bug as compared to a control plant.

12. A transgenic seed of a transgenic plant of claim 11.

13. A commodity product derived from the transgenic plant, or part thereof, of claim 11.

14. A method of controlling a stink bug comprising contacting the stink bug with a nucleic acid molecule that is or is capable of producing an interfering RNA molecule of claim 1 for inhibiting expression of a target gene in the stink bug thereby controlling the stink bug.

\* \* \* \* \*